United States Patent 11,931,406 (FLAVIVIRUS VACCINE) - sequence listing, part 13

SEQ ID NO: 7078 - RNA, 9876 nt, Artificial Sequence
  derived and/or modified CDS sequence (wt) from DENV-2__JN851123__SS-prME
acugcagguauaauuauuaugaugauuccaacagugauggcguuccauuuaaccacacgcaacggagaaccacacaugaucgucaguagacaagagaaagggaaaagucuucuguucaaaacagagaacggugugaacauguguacccucauggccauggaccuuggugaacugugugaagacacaaucacuuauaauuguccucuucucaagcagaaugaaccagaagacauagacuguuggugcaacucuacgucuacauggguaacuuaugggacaugcaccgccacaggagaacacagaagggaaaaaagaucaguagcacucguuccacaugugggaaugggacuggagacacgaacugagacauggaugucaucagaaggggccuggaaacaugcacagagaauugaaacuugggucuugagacauccaggcuucaccauaauggcagcuauccuggcauacaccauaggaacaacauauuuccaaagaguccugauuuucaucuuacugacagcugucgcuccuucaaugacaaugcguuguauaggaauaucaaauagagacuuuguggaagggguuucaggaggaagcuggguugauauagucuuggaacauggaagcugugugacgacaauggcgaaaaauaaaccaacauuggauuuugaacugauaaaaacagaagccaaacaucccgccacucuaaggaaguauuguauugaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaauugugcaaccagaaaacuuggaguacaccauugugauaacaccucacucaggggaagagaaugcaguuggaaaugacacaggaaaacacggcaaggaaauuaaaguaacaccacagaguuccauuacagaagcagaacuaacaggcuauggcacugucacgauggaaugcucuccgagaacgggccucgacuucaaugagaugguguugcugcagauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaagauguuguuguuuuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaggacagcccagucaacauagaagcagaaccuccauucggagacagcuacaucauuauaggaguagagccgggacaacugaagcuuagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugcuuucaguggaguuucauggacuaugaaaauccucauaggagucgucaucacauggauaggaaugaauucacgcagcaccucacugucugugucacuaguauuagugggagucgugacauuguauuuggggguuauggugcaggccgauagugguugcguugugaguuggaaaaacaaagaacugaaauguggcagugggauuuuuauuacagacaacgugcacacauggacagaacaauacaaauuccaaccagaauccccuucaaagcuggcuucagcuauccagaaggcucaugaagagggcauuuguggaauccgcucaguaacaagacuggagaaucugauguggaaacaaauaacaccagaacugaaucacauucuaucagaaaaugagauaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaauacaaacagagcuuggaacucacuagaaguugaagacuaugguuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacauacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggauuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcagucucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccauuaaaugaggcuauuauggcagucgggauggugagcauuuuagccaguucucucuuaaagaaugauauucccaugacaggaccauuaguggcuggagggcuucucacuguguguuacgugcuuacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaggugaaaaaacaacgagccggaguauugugggaugucccuucaccuccaccugugggaaaggccgaacuggaagauggagccuauagaaucaagcagaaagggauucuaggguacucgcagaucggagccggaguuuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucucccggaacgucaggaucuccaaucgucgacaaaaaaggaaaaguugugggccuuuauggcaacggugucgucacaaggaguggaacauauguaagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauucuagcccccacuagaguuguggcggccgaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuaucauggaugaagcccauuuuacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugauggugaauaccgcuugagaggagaagcgaggaaaacauuuguggaccuaaugagaagaggagaccuaccagucuggcuagccuacagaguggcagcugaagguaucaacuacgcagacaggagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcgcucaaagaauucaaggaauucgcagcuggaagaaaaucccuaaccuugaaucuaaucaccgagauggguaggcucccaaccuucaugacccagaaagcaaggaaugcauuggacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaaacagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucauuacaccaauguugagacauagcauugaaaauuccucagugaaugugucucuaacagccauugccaaccaagccacaguguuaaugggucuugggaaaggauggccauugucaaaaauggacaucggaguuccccuucucgcuaucggaugcuauucacaagucaaccccauaacucucacagcagcccuucucuuauugguggcacauuacgcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgucacucaaguauugaugaugaggacuacaugggcuuuaugugaagcucuaaccuuagcgaccgggcccaucucuacacugugggaaggaaauccagggagauuuuggaauacaaccauugcagugucaauggccaacauuuuuagagggaguuaccuggccggagccggacuucucuuuucuaucaugaagaacacggccaacacaagaagaggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcugugucacgaggcucggcgaaacugagaugguucaucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugaugucuuuuuuacuccgccagaaaaaugugacacauugcugugugacauaggggagucgucaccaaaccccacgguugaggcaggacggacacucagaguucuaaacuuaguggaaaacuggcugaacaacaacacccaauuuugcauaaagguucucaacccauacaugccuucagucauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggcuacauacgagccagauguugaucucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccacggcaguuacgaaacaaaacagacuggaucagcaucauccauggugaacggagugguuaggcugcuaacaaaaccuugggacgucaucccuauggugacacagauggcaaugacagacacgacuccguuuggacaacagcgcguuuucaaagagaaaguggacacgagaacccaagaaccgaaagaagggacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucagauuaacguaccaaaacaagguggugcgugugcaaagaccgacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacugguuaguaagaguggggcgugagagguuaucaagaauggccauuaguggagaugauuguguugugaaacccuuagaugacagguuugcaagugcucuaacagcucuaaaugacaugggaaagguuaggaaagacauacaacaaugggaaccuucaagaggauggaacgacuggacacaagugcccuuuuguucacaccauuuccaugaguuaaucaugaaggacggucguguacucguaguuccauguagaaaccaagaugaacugauugguagggcccgaauuucccagggagccgggugguccuugcgggaaacagccuguuuggggaagucuuacgcccaaauguggagccugauguacuuccacagacgugaccucaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaauagaaucaugggaggaaaucccauauuuggggaaaagagaagaccaauggugcggcucacugauugggcuaacaagcagggccaccugggcaaagaacauccaaacagcaauaaaucaaguuagaucccuaauaggcaaugaggaauacacagacuacaugccauccaugaaaagauucagaagagaagaggaagaagcaggaguauugugguag

SEQ ID NO: 7079 - RNA, 9876 nt, Artificial Sequence
  derived and/or modified CDS sequence (wt) from DENV-2__JN851118__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggaucuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguacaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7080 - RNA, 9876 nt, Artificial Sequence
  derived and/or modified CDS sequence (wt) from DENV-2__JN851124__SS-prME
accgcagguauaauuauuaugaugauuccaacagugauggcguuccauuuaaccacacgcaacggagaaccacacaugaucgucaguagacaagagaaaggaaaaagucuucuguuuaaaacagagaacggugugaacaugugcacccucauggccauggaccuuggugaacugugugaagacacaaucacuuauaauuguccucuucucaagcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuugggucaugagacauccaggcuucaccguaauggcagcaauccuggcauacaccauaggaacgacauauuuccaaagaguccugauuuucaucuugcugacagcugucgcuccuucaaugacaaugcguuguauaggaauaucaaauagagacuuuguggaagggguuucaggaggaagcuggguugacauagucuuggaacauggaagcugugugacgacgauggcgaagaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaaaggaggcaucgugaccugugcaauguucacauguaaaaagaacauggaaggaaaagucgugcaaccagaaaauuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggucucgacuucaaugagaugguguugcugcaaauggaaaacaaagcuuggcuggugcacaggcaaugguucuuagaccugccguuaccauggcugcccggagcagacacacaaggaucaaacuggauacagaaggagacauuggucacuuucaaaaauccccaugcaaagaaacaggauguuguuguuuuaggaucccaagaaggggcuaugcauacagcacucacaggggccacggaaauccagaugucgucaggaaacuuacuguucacaggacaucuuaagugcagguugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggacuuggaaaaaagacaugucuuaggucgccugauuacagucaacccaauugucacagaaaaagacagcccagucaacauagaagcagaaccuccauucggagacagcuauaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacguagcaccucacugucugugucauuaguauuagugggggucgugacacuguauuugggaguuauggugcaggccgauagugguuguguugugaguuggaaaaacaaagaacugaaauguggcagugggauuuuuauuacagacaacgugcacacauggacagaacaauacaaauuccaaccagaauccccuucaaagcuggcuucagcuauucagaaggcucaugaagaaggcauuuguggaauccgcucaguaacaagacuggagaaucugauguggaaacaaauaacaccagaacugaaucacauucuaucagaaaaugagguaaagaugacuaucaugacaggagacauuaaaggaauuaugcaggcaggaaaacgaucccugcggccucaacccacugagcugaaguacucuuggaaagcauggggcaaagcgaaaaugcucuccacagaacuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguaucuugugacucaaaacucaugucagcagccauaaaggacaacagagccguccacgccgacauggguuauuggauagaaagcgcacucaaugacacauggaagauugagaaagccucuuucauugaaguuaaaagcugccacuggccaaagucacacacccucuggaguaauggagugcuagaaagugagaugauaauuccaaagaauuuugcaggaccaguaucacaacacaauuauagaccaggcuaucauacacaaacggcaggacccuggcaucuagguaggcuugagauggacuuugauuucugcgaaggaaccacagugguggugacugaggacuguggaaauagaggacccucuuuaagaacaaccacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuaccaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucguacuccucucccagagcaccauaccagagacuauacuugaacugacugacgcguuggcuuuagggaugaugguucuuaaaguagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaacgaggcuauuauggcagucgggauggugagcauuuuagccaguucucucuuaaaaaaugauauucccaugacaggaccauuaguggcuggagggcuucucacuguguguuacgugcucacuggaagaucggcugauuuggaacuggagagagcugcugacguaagaugggaagaacaagcagagauaucaggaaguaguccaauucuaucgauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaagugaaaaaacaacgagcaggaguauugugggaugucccuucacccccaccugugggaaaggcugaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuaugguaacggugucgucacaaggaguggaacauaugugagugccauagcccagacugaaaaaagcaucgaagacaauccagagauugaagaugacaucuuucgaaagaaaagauugaccaucauggaccuucacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacccgaguagagaugggugaagcagcugggauuuuuaugacagcuacccccccaggaagcagagacccauuuccucagagcaaugcaccaaucauggaugaagaaagggaaaucccugagcguucguggaacucuggacaugagugggucacggauuuuaaagggaagacuguuugguuuguuccaaguauaaaagcagggaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggccgagaggguuauagaccccagacgcugcaugaaaccaguaauacuaacagauggugaagagcggguaaucuuggcaggacccaugccagugacccacucuagugcagcacaaagaagagggagaguaggaagaaauccaaaaaaugaaagugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugauggugaauaccgcuugagaggagaagcgaggaaaacuuucguggaccuaaugagaagaggagaccuaccagucuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcaguccugcacacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguagcugcaaccauggcaaacgagauggguuuccuggaaaaaacaaagaaagauuuuggauugggaagcaguacaacccagcaacaugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgccaucgggugcuauucacaagucaaccccauaacucucacagcagcccuucucucauugguagcacauuaugccaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcagcugggacaaguaaugcucuuaguccucugcgugacucaaguguugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuucucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaaccuauucccaugucaacauacgguuggaaucuggugcgucuucaaaguggaguugauguuuuuuuuacuccgccagaaaagugugacacauugcugugugacauaggggagucaucaccaaaccccacgguugaggcaggaagaacacucagaguucuaaacuuaguggaaaauuggcugaacaacaacacccaauuuugcauaaagguucucaacccauauaugcccucaguuauagaaaaaauggaagcgcuacaaaggaaauacggaggagcuuuggugagaaauccacucucacgaaauuccacacacgagauguacuggguauccaaugcuuccgggaacauagugucaucagugaacaugauuucaagaauguuaauuaacagauucacaaugagacacaagaaggucacauacgagccagauguugaccucggaaguggaacucgcaauaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggaugucauccccauggugacacagauggcaaugacagacacgacuccauuuggacaacagcgcguuuucaaagagaagguggacacgagaacccaagaaccgaaagaaggcacgaaaaagcuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaguugguugacaaggaaaggaaucuccaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcguguacaaagaccaacaccaagaggcacaguaauggacauuauaucgagaagagaccaaagagguaguggacaaguugucacuuauggccucaauacuuucaccaacauggaagcccaacugaucagacagauggagggagaaggagucuucaaaagcauccagcaacugacagccacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacagcaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuuggggaagucuuacgcccaaauguggagccugauguacuuccacagacgcgaucuuaggcuggcggcaaaugccauuugcucggcagucccaucacacuggguuccaacaagucgaacaaccugguccauacacgccacacaugaguggaugacaacagaagacaugcugacagucuggaacaggguguggauccaagaaaacccauggauggaagacaagacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 7081 - RNA, 9876 nt, Artificial Sequence
  derived and/or modified CDS sequence (wt) from DENV-2__JN851114__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaacuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcuuaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccuguggaaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuacgaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuucaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7082 - RNA, 9876 nt, Artificial Sequence
  derived and/or modified CDS sequence (wt) from DENV-2__JN851126__SS-prME
acugcagguauaauuauuaugaugauuccaacagugauggcguuccauuuaaccacacgcaacggagaaccacacaugaucgucaguagacaagagaaagggaaaagucuucuguucaaaacagagaacggugugaacauguguacccucauggccauggaccuuggugaacugugugaagacacaaucacuuauaauuguccucuucucaagcagaaugaaccagaagacauagacuguuggugcaacucuacgucuacauggguaacuuaugggacaugcaccgccacaggagaacacagaagggaaaaaagaucaguagcacucguuccacaugugggaaugggacuggagacacgaacugaaacauggaugucaucagaaggggccuggaaacaugcacagagaauugaaacuugggucuugagacauccaggcuucaccauaauggcagcuauccuggcauacaccauaggaacaacauauuuccaaagaguccugauuuucaucuuacugacagcugucgcuccuucaaugacaaugcguuguauaggaauaucaaauagagacuuuguggaagggguuucaggaggaagcuggguugauauagucuuggaacauggaagcugugugacgacgauggcgaaaaauaaaccaacauuggauuuugaacugauaaagacagaagccaaacaucccgccacucuaaggaaguauuguauugaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaauugugcaaccagaaaacuuggaguacaccauugugauaacaccucacucaggggaagagaaugcagucggaaaugacacaggaaaacacggcaaggaaauuaaaguaacaccacagaguuccauuacagaagcagaacuaacaggcuauggcacugucacgauggaaugcucuccgagaacgggccucgacuucaaugagaugguguugcugcagauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguuuuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaggacagcccagucaacauagaagcagaaccuccauucggagacagcuacaucauuauaggaguagagccgggacaacugaagcuuagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugcuuucaguggaguuucauggacuaugaaaauccucauaggagucgucaucacauggauaggaaugaauucacgcagcaccucacugucugugucacuaguauuagugggagucgugacauuguauuuggggguuauggugcaggccgauagugguugcguugugaguuggaaaaacaaagaacugaaauguggcagugggauuuuuauuacagacaacgugcacacauggacagaacaauacaaauuccaaccagaauccccuucaaagcuagcuucagcuauccagaaggcucaugaagagggcauuuguggaauccgcucaguaacaagacuggagaaucugauguggaaacaaauaacaccagaacugaaucacauucuaucagaaaaugagauaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaauacaaacagagcuuggaacucgcuagaaguugaagacuaugguuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacauacucucuggaguaauggagugcuagaaagugagaugauaauuccaaagaauuuugcaggaccagugucacaacacaauuacagaccaggcuaucauacacagacggcaggacccuggcaucuaggcaggcuugagauggacuuugauuucugcgaaggaaccacagugguggugacugaggauuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuuaggaauggcauuguuccuggaagagaugcucaggacccgaguaggaacgaaacacacaauauuacuaguugcagucucuuuugugacauugaucacagggaacaugucuuuucgagauuuggggagagugguggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuauuauggcuaucuugugcgucccaaaugcagugauauuacaaaacgcauggaaagugagcugcacagcacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccauuaaaugaggcuauuauggcagucgggauggugagcauuuuagccaguucucucuuaaagaaugauauucccaugacaggaccauuaguggcuggagggcuucucacuguguguuacgugcuuacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacaaacacugaccauacucaucagaacaggacugcuggugauaucaggacuuuuucccgugucaauaccaaucacggcagcugcaugguaccugugggaggugaaaaaacaacgagccggaguauugugggaugucccuucaccuccaccugugggaaaggccgaacuggaagauggagccuauagaaucaaacagaaagggauucuaggguacucgcagaucggagccggaguuuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguucaaacaaaacccggucuuuuuaaaacuaacacuggaaccauaggcgccguaucucuggacuuuucucccggaacgucaggaucuccaaucgucgacaaaaaaggaaaaguugugggccuuuauggcaacggugucgucacaaggaguggaacauauguaagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuagcccccacuagaguuguggcggccgaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuauuauggaugaagcccauuucacagacccagcaagcauagcagcuagaggauacauuucaacucgaguagagaugggugaagcagcugggauuuucaugacagcuaccccucccggaagcagagacccauuuccucagagcaacgcaccaaucauggaugaagaaaaggaaaucccugagcguucguggaacucuggacaugaguggguuacggauuuuaaagggaagacuguuugguuuguuccaaguauaaaagcaggaaaugacauagcagcuugccugagaaagaauggaaagaaagugauacaacucagcaggaagaccuuugauucugaauauaucaagacuaggaccaacgauugggacuuuguggucacgacagacauuucagaaaugggugcuaacuucaaggcugagaggguuaucgaccccagacgcugcgugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugacggugaauaccgcuugagaggagaagcgaggaaaacauuuguggaccuaaugagaagaggagaccuaccagucuggcuagccuacagaguggcagcugaagguaucaacuacgcagacaggagauggugcuuugauggagucaagaacaaccaaaucuuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccuaaccuugaaucuaaucaccgagauggguaggcucccaaccuucaugacccagaaagcaaggaaugcauuggacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaaacagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucggaugcuauucacaagucaaccccauaacucucacagcagcccuucucuuauugguggcacauuacgcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgucacucaaguauugaugaugaggacuacaugggcuuuaugugaagcucuaaccuuagcgaccgggcccaucucuacacugugggaaggaaauccagggagauuuuggaauacaacuauugcagugucaauggccaacauuuuuagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaccuauaagaaaaguggaauccaggaaguggauagaaccuuagcaaaagaaggcaucaaaagaggagaaacggaccaucacgcugugucacggggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugaugucuuuuuuacuccgccagaaaaaugugacacauugcugugugacauaggggagucgucaccaaaccccacgguugaggcaggacggacacucagaguucuaaacuuaguggaaaacuggcugaacaacaacacccaauuuugcauaaagguucucaacccauacaugccuucggucauagaaaaaauggaaacgcugcaaaggaaacacggaggagcuuuggugaggaauccacucucacgaaauuccacacacgagauguacuggguaucuaaugcuuccgggaacauagugucaucagugaacaugauuucaagaauguugauuaacagauucacaaugagacauaagaaagccacauacgagccagauguugaucucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccacggcagcuacgaaacaaaacagacuggaucagcaucauccauggugaacggagugguuaggcugcuaacaaaaccuugggacgucaucccuauggugacacagauggcaaugacagacacgacuccguuuggacaacagcgcgucuucaaagagaaaguggacacgagaacccaagaaccgaaagaagggacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaaaucggcacgugaggcuguugaagacaguagauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucagauuaacguaccaaaacaagguggugcgugugcaaagaccgacaccaagaggcacaguaauggacauuauaucgagaagagaccaaagagguaguggacaaguagucaccuacggccucaauacuuucaccaacauggaagcccaacugaucagacagauggagggagaaggaguauucaaaagcauccagcaccugacagucacagaagaaauugcagugaaaaacugguuaguaagaguggggcgugagagguuaucaagaauggccaucaguggagaugauuguguugugaaacccuuagaugacagguuugcaagugcucuaacagcucugaaugacaugggaaagguuaggaaagacauacaacaaugggaaccuucaagaggauggaacgacuggacacaagugcccuuuuguucacaccauuuccaugaguuaaucaugaaggacggucguguacucguaguuccauguagaaaccaagaugaacugauugguagggcccgaauuucccagggagccgggugguccuugcgggaaacagccuguuuggggaagucuuacgcccaaauguggagcuugauguacuuccacagacgugaccucaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucacugauugggcuaacaagcagggccaccugggcaaagaacauccaaacagcaauaaaucaaguuagaucccuaauaggcaaugaggaauacacagacuacaugccauccaugaaaagauucagaagagaagaggaagaagcaggaguauugugguag

SEQ ID NO: 7083 - RNA, 9876 nt, Artificial Sequence
  derived and/or modified CDS sequence (wt) from DENV-2__JN851121__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacucuaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacgacaaugagaggagcgaagagaauggccauuuuaggugacacagcuugggauuuuggaucccugggaggaguguucacaucuauaggaaaggcccuccaccaagucuuuggagcuaucuauggggcugccuucagcgggguuucauggacuaugaaaauccucauaggagucgucaucacauggauaggaaugaauucacgcagcaccucacugucugugucacuaguauuagugggggucgugacauuguauuugggagcuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacugaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcgcaaagaagagggagaguaggaagaaauccaaaaaaugaaaaugaccaguacauauacaugggggaaccucuggaaaaugaugaagacugugcacacuggaaagaagccaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaauuuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcaucacaaaccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcaaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacacgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucaccgaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7084 - RNA, 9876 nt, Artificial Sequence
  derived and/or modified CDS sequence (wt) from DENV-2__JN851115__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaauggcucuuagaccugccguuaccauggcugcccggagcagacacacaaggaucaaauuggauacagaaggagacacuggucacuuucaaaaauccccaugcaaagaaacaggauguuguuguuuuagguucccaagaaggagccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaauggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaagcgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguagugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaaacuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcuaugaggaauacacagacuacaugccaucuaugaaaagauucagaagagaagaggaagaggcaggagucuugugguag

SEQ ID NO: 7085 - RNA, 9876 nt, Artificial Sequence
  derived and/or modified CDS sequence (wt) from DENV-2__JN851127__SS-prME
acugcagguauaauuauuaugaugauuccaacagugauggcguuccauuuaaccacacgcaacggagaaccacacaugaucgucaguagacaagagaaagggaaaagucuucuguucaaaacagagaauggugugaacauguguacccucauggccauggaccuuggugaacugugugaagacacaaucacuuauaauuguccucuucucaagcagaaugaaccagaagacauagacuguuggugcaacucuacgucuacauggguaacuuaugggacaugcaccgccacaggagaacacagaagggaaaaaagaucaguagcacucguuccacaugugggaaugggacuggagacacgaacugagacauggaugucaucagaaggggccuggaaacaugcacagagaauugaaacuugggucuugagacauccaggcuucaccauaauggcagcuauccuggcauacaccauaggaacaacauauuuccaaagaguccugauuuucaucuuacugacagcugucgcuccuucaaugacaaugcguuguauaggaauaucaaauagagacuuuguggaagggguuucaggaggaagcuggguugauauagucuuggaacauggaagcugugugacgacaauggcgaaaaauaaaccaacauuggauuuugaacugauaaagacagaagccaaacaucccgccacucuaaggaaguauuguauugaggcaaagcugaccaacacaacaacagcaucucgcugcccaacacaaggagaaccuagccuaagugaagaacaggacaaaagauuugucugcaaacacuccaugguagacagaggauggggaaauggaugcggauuauuuggaaagggagguaucgugaccugugcaauguucacaugcaaaaagaacauggaaggaaaaauugugcaaccagaaaacuuggaguacaccauugugauaacaccucacucaggggaagagaaugcaguuggaaaugacacaggaaaacacggcaaggaaauuaaaguaacaccacagaguuccauuacagaagcagaacuaacaggcuauggcacugucacgauggaaugcucuccgagaacgggccucgacuucaaugagaugguguugcugcagauggaaaacaaggcuuggcuggugcacaggcaaugguucuuagacuugccauuaccauggcugcccggagcagacacacaaggaucaaauuggauacagaaggagacauuggucacuuucaaaaauccccaugcaaagaaacaagauguuguuguuuuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaggacagcccagucaacauagaagcagaaccuccauucggagauagcuacaucauuauaggaguagagccgggacaacugaagcuuagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugcuuucaguggaguuucauggacuaugaaaauccucauaggagucgucaucacauggauaggaaugaauucacgcagcaccucacugucugugucacuaguauuagugggagucgugacauuguauuuggggguuauggugcaggccgauagugguugcguugugaguuggaaaaacaaagaacugaaauguggcagugggauuuucauuacagacaacgugcacacauggacagaacaauacaaauuccaaccagaauccccuucaaaguuggcuucagcuauccagaaggcucaugaagagggcauuuguggaauccgcucaguaacaagacuggagaaucugauguggaaacaaauaacaccagaacugaaucacauucuaucagaaaaugagauaaaguugacuaucaugacaggagacauuaaaggaaucaugcaggcaggaaaacgaucccugcggccucaacccauugagcugaaguacucuuggaaagcauggggcaaagcgaaaaugcucuccacagagcuucauaaccacaccuuucucauugauggccccgaaacagcagaaugucccaauacaaacagagcuuggaacucacuagaaguugaagacuaugguuuuggaguauucaccaccaacauauggcugaaauugaaagaaaggcaggauguauuuugugacucaaaacucaugucagcagucauaaaagacaacagagccguccacgccgauauggguuauuggauagaaagcgcacucaaugacacauggaagauugagaaagccucuuuuauugaaguuaaaagcugccacuggccaaagucacauacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggauuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcagucucuuucgugacauugaucacagggaacaugucuuuucgagauuuggggagagugauggucauggugggcgcuacuaugacggaugacauaggcaugggcgugaccuaucuugcccuauuagcagccuucaaagucagaccaacuuuugcagcuggacuacucuuaagaaagcugaccuccaaggaauugaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacggcagaaagcggauuggauaccacuggcguugacgaucaaaggccucaauccaacagccauuuucuuaacaacccucucaagaacuagcaagaaaaggagcuggccauuaaaugaggcuauuauggcagucgggauggugagcauuuuagccaguucucucuuaaagaaugauauucccaugacaggaccauuaguggcuggagggcuucucacuguguguuacgugcuuacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaggugaaaaaacaacgagccggaguauugugggaugucccuucaccuccaccugugggaaaggccgaacuggaagauggagccuauagaaucaagcagaaagggauucuaggguacucgcagaucggagccggaguuuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucucccggaacgucaggaucuccaaucgucgacaaaaaaggaaaaguugugggccuuuauggcaacggugucgucacaaggaguggaacauauguaagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauucuagcccccacuagaguuguggcggccgaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacaucucaacucgaguagagaugggugaagcagcugggauuuucaugacagcuaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugauggugaauaccgcuugagaggagaagcgaggaaaacauucguggaccuaaugagaagaggagaccuaccagucuggcuagccuacagaguggcagcugaagguaucaacuacgcagacaggagauggugcuuugauggagucaagaacaaucaaaucuuggaagaaaauguggaaguggaaauuuggacaaaagaaggagaaaggaagaaauuaaaacccagaugguuagaugcuaggaucuacucugacccacuggcgcucaaagaauucaaggaauucgcagcuggaagaaaaucccuaaccuugaaucuaaucaccgagauggguaggcucccaaccuucaugacccagaaagcaaggaaugcauuggacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaaacagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucggaugcuauucacaagucaaccccauaacucucacagcagcccuucucuuauugguggcacauuacgcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgucacucaaguauugaugaugaggacuacaugggcuuuaugugaagcucuaaccuuagcgaccgggcccaucucuacacugugggaaggaaauccagggagauuuuggaauacaaccauugcagugucaauggccaacauuuuuagagggaguuaccuggccggagccggacuucucuuuucuaucaugaagaacacggccaacacaagaaggggaacuggcaacacaggagagacgcuuggagagaaauggaaaaaccgguugaaugccuuggggaagagugaauuccagaucuauaagaaaaguggaauccaggaaguggauagaaccuuagcaaaagaaggcaucaaaagaggagaaacagaccaucacgcugugucacgaggcucggcgaaacugagaugguucaucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugacgucuuuuuuacuccgccagaaaaaugugacacauugcugugugacauaggggagucgucaccaaaccccacgguugaggcaggacggacacucagaguucuaaacuuaguggaaaacuggcugaacaacaacacccaauuuugcauaaagguucucaacccauacaugccuucagucauagaaaaaauggaagcgcugcaaaggaaauacggaggagcuuuggugaggaauccacucucacgaaauucuacacacgagauguacuggguauccaaugcuuccgggaacauagugucaucagugaacaugauuucaagaauguugauuaacagauucacaaugagacauaagaaggcuacauacgagccagauguugaucucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccacggcaguuacgaaacaaaacagacuggaucagcaucauccauggugaacggagugguuaggcugcuaacaaaaccuugggacgucaucccuauggugacacagauggcaaugacagacacgacuccguuuggacaacagcgcguuuucaaagagaaaguggacacgagaacccaagaaccgaaagaagggacgaaaaaacuaaugaaaaucacggcagaauggcucuggaaagaacuaggaaagagaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggaguacacaagaaacuugcugaagccauuuucagauuaacguaccaaaacaagguggugcgugugcaaagaccgacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacugguuaguaagaguggggcgugagagguuaucaagaauggccauuaguggagaugauuguguugugaaacccuuagaugacagguuugcaagugcucuaacagcucuaaaugacaugggaaagguuaggaaagacauacaacaaugggaaccuucaagaggauggaacgacuggacacaagugcccuuuuguucacaccauuuccaugaguuaaucaugaaagacggucguguacucguaguuccauguagaaaccaagaugaacugauugguagggcccgaauuucccagggagccgggugguccuugcgggaaacagccuguuuggggaagucuuacgcccaaauguggagccugauguacuuccacagacgugaccucaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaauagaaucaugggaggaaaucccauauuuggggaaaagagaagaccaauggugcggcucacugauugggcuaacaagcagggccaccugggcaaagaacauccaaacagcaauaaaucaaguuagaucccuaauaggcaaugaggaauacacagacuacaugccauccaugaaaagauucagaagagaagaggaagaagcaggaguauugugguag

SEQ ID NO: 7086 - RNA, 9876 nt, Artificial Sequence
  derived and/or modified CDS sequence (wt) from DENV-2__JN851120__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccguaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucccgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucauucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcugcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaggcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaagacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugacuuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugccuuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaauagaagaggaagaggcaggagucuugugguag

SEQ ID NO: 7087 - RNA, 9876 nt, Artificial Sequence
  derived and/or modified CDS sequence (wt) from DENV-2__JN851131__SS-prME
acugcagguguaaucauuaugaugauuccaacagugauggcguuccauuuaaccacacgcaacggagaaccacacaugaucgucaguagacaagagaaagggaaaagucuccuguucaaaacagagaacggugugaacauguguacccucauggccauagaccuuggugaauugugugaagacacaaucacuuauaauuguccucuucucaggcagaaugaaccagaagacauagacuguuggugcaacucuacgucaacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucauuuuacugacagcugucgcuccuucaaugacaaugcguugcauaggaauaucaaacagagacuuuguggaagggguuucaggaggaagcuggguugacauagucuuagaacauggaagcugugugacgacgauggcgaaaaacaaaccaacauuggauuuugaacugauaaaaacggaagccaaacaucccgccacucuaaggaaguauuguauagaggcaaagcugacuaacacaacaacagcaucucgcugcccaacacaaggagaaccuagcuuaaaagaagaacaggacaaaagguuugucuguaaacacuccaugguggacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugauacaggaaaacacggcaaggaaauuaaaguaacaccacagaguuccauuacagaagcagaacugacaggcuauggcacugucacgauggaaugcuccccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggagccacggaaauccagaugucaucaggaaacuuacuguucacaggacaucuuaagugcaggcugagaauggacaaacuacagcucaaaggaaugucauauucuaugugcacaggaaaguuuaaaguugugaaggaaauagcagaaacacaacauggaacaauaguuaucagaguacaauaugaaggggacgguucuccguguaagaucccuuuugaaauaauggauuuggagaaaagacaugucuuaggucgcuugaucacagucaacccaauugucacagaaaaagacagcccagucaacauagaagcagaaccuccauucggagacagcuacaucauuauaggaguagaaccgggacaacugaaacucagcugguuuaagaaaggaaguucuauuggccaaauguuugagacaacaaugagaggagcgaagagaauggccauuuuaggugacacagcuugggacuuuggaucccugggaggaguguucacaucuauaggaaaggcccuccaccaagucuuuggagcaaucuauggggcugccuucagcgggguuucauggacuaugaaaauccucauaggagucgucaucacauggauaggaaugaauucacgcagcaccucacugucugugucacuaguauuagugggggucgugacauuguauuugggagucauggugcaggccgauagugguugcgucgugaguuggaaaaacaaagaacugaaaugugguagugggauuuuuaucacagacaacguacacacauggacagaacaauacaaauuucaaccagaauccccuucaaagcuagccucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaaacauggggcaaagcaaaaaugcucuccacagagcuucauaaccacaccuuucucauugauggccccgaaacagcagaaugucccaacacaaacagagcuuggaacucacuagaaguugaagauuaugguuuuggaguauucaccaccaacauauggcugaaacugaaagaaaggcaggaaguauuuugugacucaaaacucaugucagcagccauaaaagacaauagggccguccacgccgauauggguuauuggauagaaagcgcacuuaaugacacauggaagauugagaaagccucuuucauugaaguuaaaagcugccacuggccaaagucacacacccucuggaguaauggagugcuagaaagugagaugauaauuccaaagaauuuugcaggaccagugucacagcacaacuacaggccaggcuaucacacacaaacggcaggacccuggcaucuagguaagcuugagauggacuuugauuucugcgaaggaaccacagugguagugacugaggacuguggaaacagaggacccucuuuaagaacaacuacugcuucuggaaaacucauaacagaauggugcugccgaucuugcacauuaccaccgcuaagguacagaggugaggauggaugcugguauggaauggaaaucagaccaucgaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauugcuaguugcaguuucuuucgugacauugaucacagggaacauguccuuucgagauuuggggagagugaugguuauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucagcuagcagugacuaucauggccaucuugugcgucccaaaugcagugauauuacaaaacgcauggaaagugagcugcacaacacuggcagugguguccguuuccccacugcuuuuaacauccucacagcagaaagcggacuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguagcuggagggcuucucacuguguguuacgugcucacuggaagaucggcugauuuggaacuagagagagcugcugacguaagaugggaagaacaggcagagauaucaggaaguaguccaauucugucaauaacaauaucggaagaugguagcaugucgauaaaaaaugaagaagaagaacaaacauugaccauacucauuaggacaggacugcuggugauaucaggacuuuuucccgugucaauaccaaucacggcagcugcaugguaccugugggaagugaaaaaacaacgagccggaguauugugggaugucccuucacccccaccuguaggaaaggccgaacuggaagauggagccuauagaaucaagcagaaagggauucuaggauacucgcagaucggggccggaguuuacaaagaaggaacauuccacacaauguggcacgucacacguggugcuguccuaaugcauaaagggaagagaauugaaccgucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggcgucgucacaaggaguggaacauaugugagugccauagcccagacugaaaaaagcauugaagacaauccagagauugaagaugacaucuuucgaaagaaaagauugaccaucauggaccuccacccaggagcgggaaaaacgaagagauaccuuccagcaauagucagagaagccauaaaacgagguuugaggacacuaauccuggcccccacuagaguuguggcggcugaaauggaagaagcucucagaggacuuccaauaagauaccaaaccccagccaucagaguugagcacacugggcgggagauuguggaucuaaugugucacgccacauuuaccaugaggcugcuauccccaauuagaguaccaaauuacaaccugaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaguggaucacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccaggcgcugcaugaaaccagucauacuaacagauggugaagagcgggugauucuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagacaacaucaacacgccugaaggaaucauucccagcauguucgaaccagagcgugaaaagguggaugcuauugauggugaauaccgcuuaagaggagaagcaaggaaaacuuuuguggaccuaaugagaagaggagaccuaccagucuggcuagccuacagaguggcagcugaaggcaucaacuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucucugacccugaaucuaaucacagagauggguaggcucccaaccuucaugacccagaaagcaaggaacgcacuagacaaucuagcaguccugcauacggcugaagcaggcggaagggcguacaaucaugcucuuagugaacugccggagacccuggagacauugcuuuuauugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaucaauuaacuuauguugucauagccauccuuacagugguggcagcaaccauggcaaacgagauggguuuccuggaaaaaacaaagaaagauuucggauugggaagcauugcaauccagcaaccugagagcaacauccuggacauagaucuacgcccugcaucagcuuggacucuauaugcuguggcaacaacuuucauuacaccaaugcugagacacagcauugaaaauuccucagugaaugugucucuaacggccauugccaaccaagccacaguguuaaugggccuugggaaaggauggccauugucaaaaauggacaucggaguuccccuucucgcuaucgggugcuauucgcaaguuaaccccauaacucucacggcagcccuucucuuauugguagcacauuaugccaucauagggccaggacuccaagcgaaagcaacuagagaagcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgaccgggcccauuuccacacugugggaaggaaauccagggagauuuuggaauacaacuauugcagugucaauggcuaacauuuuuagagggagcuacuuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaaccuuagcaaaagaagggaucaaaagaggggaaacggaccaucacgcugugucgcgaggcucggcgaaacugagaugguucgucgagagaaaccuggucacaccagaagggaaaguaguggaccucgguugcggcagggggggcuggucauacuauugugggggacuaaagaaugugaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacugcugugcgacauaggggagucgucaccaaaccccacgguugaggcaggacgaacacucagaguucuaaaccuaguggaaaauuggcugaacaacaacacccaauuuugcauaaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaauagauucacaaugagacauaagaaggccacauacgagccagauguugaccucggaagcggaacccgcaacaucggaauugaaagugagaaaccaaaucuggacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucauccccauggugacacagauggcaaugacagacacgacuccauuuggacaacagcgcguuuucaaagagaaaguggacacaagaacccaagaaccgaaagaaggcacgaaaaaacuaaugaaaaucacggcugaauggcucuggaaagaacuaggaaagaaaaagacaccuaggaugugcaccagagaagaauucacaagaaaggugagaagcaaugcagccuuaggugccauauucacugaugagaauaaguggaagucggcacgugaggcuguugaagauaguggauucugggaacugguuaacaaggaaaggaaucuucaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacuccuugaguggaguggaaggagaagggcugcacaagcuaggcuacauuuugagagacgugagcaaaaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggaaggagaaggagucuucaaaagcauccagcaccugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucgcguacucguaguuccauguagaaaccaagaugaacugauugguagggcucgaauuucccagggagccggguggucuuugcgggaaacagccuguuuggggaagucuuacgcccagauguggagccugauguacuuccacagacgugaccuuaggcuggcggcaaaugcuauuugcucggcagucccaucacauuggguuccaacaagucgaacgaccugguccauacaugccacacaugaguggaugacaacagaagauaugcugacagucuggaacaggguguggauucaagaaaacccauggauggaagacaaaacuccaguagaaucaugggaagaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7088 - RNA, 9876 nt, Artificial Sequence
  derived and/or modified CDS sequence (wt) from DENV-2__JN851122__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcuuaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuaugugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuccuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaaacagggaaugauauagcagcuugccugagaaagaauggaaagaaagugauacaacucagcaggaaaacuuuugauucugaauauauuaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguaacccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacauaggagagacgcuuggagagaaauggaaaaaccgguugaaugcauuagggaagagugaauuccagaucuacaagaaaaguggaauccaggaaguggauagaaccuuagcaaaagaaggcaucaaaagaggagagacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccaccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuacgaccaagaccacccauacaaaacgugggccuaccauggcagcuacgaaacaaaacagacuggaucagcaucauccauggugaacggagugguuaggcugcuaacaaagccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaagguagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccuuaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacacgaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7089 - RNA, 9876 nt, Artificial Sequence
  derived and/or modified CDS sequence (wt) from DENV-2__JN851116__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaacgcauggaaagugagcugcacaauacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauuccuagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuagaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7090 - RNA, 9876 nt, Artificial Sequence
  derived and/or modified CDS sequence (wt) from DENV-2__GU370051__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaacuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacauuggauuuugaacugauaaaaacagaagccaaacaucccgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuaggaucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucgaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaauauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauuggaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaguggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcauugaagacaauccagacauugaagaugacaucuuuagaaagaaaagauugaccaucauggaccuccacccaggagcagggaaaacaaagagauaccuuccagcaauagucagagaagcuauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacggacggugaagagcgggugaucuuggcaggacccaugccagugacccauucuagugcagcacaaagaagagggagaguaggaagaaauccaaaaaaugauaaugaccaguacauauacaugggggaaccuuuggaaaaugaugaagacugugcacauuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugaaaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugacguuuuuuuuacuccgccagaaaagugugacacauugcugugugacauaggggagucgucaccaaaccccacgguugaggcaggacgaacacucagaguuuuaaacuuaguggaaaauuggcugaacaacaacacccaauuuugcauaaagguucucaccccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauaggaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaauggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaaacuaggcuacauuuuaagggacgugaguaagaaagaaggaggagcaauguaugccgaugacaccgcaggaugggacacaagaaucacacuagaggacuuaaaaaaugaagagauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggaaggagaaggagucuucaaaagcauccagcaacugacaguuaaagaagaaauugcaguggaaaacugguuaaugagaguggggcgugagagguuaucaagaauggccaucaguggagaugauuguguugugaaacccuuagaugacagguuugcaagugcucuaacagcucuaaaugacaugggaaaaguuaggaaagacauacaacaaugggaaccuucaagaggauggaacgauuggacacaagugcccuuuuguucacaccauuuccaugaguuaaucaugaaggauggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagagucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7091 - RNA, 9876 nt, Artificial Sequence
  derived and/or modified CDS sequence (wt) from DENV-2__EU359009__SS-prME
acugcagguauaauuauuaugaugaucccaacagugauggcguuccauuuaaccacacgcaauggagaaccacacaugaucgucaguagacaagagaaagggaaaagucuucuguuuaaaacagagaacggugugaacaugugcacccucauggccauggaccuuggugaacugugugaagacacaaucacuuacaauuguccucuucucaggcagaaugaaccagaagacauagacuguuggugcaacucuacgucuacauggguaacuuaugggacaugcacagcuacaggagaacacagaagggaaaaaagaucaguggcacucguuccacaugugggaaugggacuggagacacgaacugaaacauggaugucaucagaaggggccuggaaacaugcacagagaauugagaccugggucuugagacauccaggcuucaccauaauggcagcaauccuggcauacaccauaggaacgacauauuuccaaagaguccugauuuucaucuuacugacagcuaucgcuccuucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaagacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggaugggggaauggaugcggauuauuuggaaagggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggacucgacuucaaugagaugguguugcugcaaauggaaaacaaggcuuggcuggugcacaggcaaugguucuuagaccugccauuuccauggcugcccggagcagacacacaaggaucaaauuggauacagaaggagacauuggucacuuucaaaaauccucaugcaaagaaacaggauguuguuguuuuaggaucccaagaaggggcuaugcacacagcacucacaggggccacggaaauccagaugucaucaggaaacuuacuauucacaggacaucuuaaauguaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccagucaacauagaagcagaaccuccauucggagacagcuauaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauucucauaggagucgucaucacauggauaggaaugaauucacgcagcaccucacugucugugucacuaguauuagugggagucgugacauuguauuugggaguuauggugcaggccgauagugguugcguugugagcuggaaaaacaaagaacugaaauguggcagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugaggugaaguugaccaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagagguugaagauuauggcuuuggaguauucaccacuaacauauggcugaaauugaaagaaaggcaggauguauuuugugacucaaaacucaugucagcagccauaaaagacaacagagccguccacgccgacauggguuauuggauagaaagcgcacuaaaugacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcuuagaacccgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaggucagaccaacuuuugcagcuggacuacucuuaagaaagcugaccuccaaggaauugaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugacauucccaugacaggaccacuaguggcuggagggcuucucacuguguguuacgugcucacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacaaacacugaccauacugauuagaacaggacugcuggugauaucaggacuguuucccgugucaauaccaaucacggcagcugcaugguaccugugggaagugaaaaagcaacgagccggaguauugugggaugucccuucaccuccaccugugggaaaggccgaacuggaagauggagccuauagaaucaagcagaaagggauucuaggauacucgcagauaggagccggagucuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggaguggaacauaugugagugccauagcccagacugaaaaaagcauugaagacaacccagagauugaagaugacaucuuucgaaagaaaagauugaccaucauggaccuccacccaggagcaggaaaaacaaagagauaucuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucaggacaugaguggguuacggauuuuaaagggaagacuguuugguuuguuccaaguauaaaagcaggaaaugauauagcagcuugccugagaaagaauggaaagaaagugauacaacucagcaggaagacuuuugauacugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugcgcacacuggaaagaagcuaagaugcuucuagauaacaucaacacgccugaaggaaucauucccagcauguuugaaccagagcgugaaaaggucgacgccauugauggugaauaccgcuugagaggagaagcgaggaaaacauuuguggaccuaaugagaagaggggaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcgcucaaagaauuuaaggaauucgcagcuggaagaaaaucccugacccugaaucuaaucaccgagauggguaggcucccaaccuucaugacccagaaagcaaggaaugcauuggacaacuuagcaguccuacauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacagccaguauucuccuaugguaugcacaaauacagccacauuggauagcagcuucaauaauacuggaguuuuuucucauagucuugcucauuccagagccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucgaaaauggacaucggaguuccccuucucgcuauuggaugcuauucacaagucaaccccauaacccucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaacacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaacuuuagcaaaagaaggcaucaagagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuccaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucuuaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaggccacauacgagccggauguugaucucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccaaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuagguuucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggauuugaaaaaugaagaaauggugacaaaccacauggaaggagaacacaagaaacuugcugaagccauuuucagauuaacguaccaaaacaaaguggugcgugugcaaagaccgacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaucugacagucacagaagaaauugcagugaaaaacugguuaguaagaguggggcgugagagguuaucaagaauggccaucagcggagacgauuguguugugaaacccuuagaugacagguuugcaagcgcucuaacagcucuaaaugacaugggaaaggucaggaaagacauacaacaaugggaaccuucaagaggauggaacgauuggacacaagugcccuuuuguucacaccauuuccaugaguuaaucaugaaggacggucguguacuugugguuccauguagaaaccaagaugaacugauugguagggcccgaauuucccagggagccgggugguccuugcgggaaacagccuguuuggggaagucuuacgcccaaauguggagccuaauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauccaagaaaacccauggauggaagacaaaacuccaguagaaucaugggaggaaaucccauauuuggggaagagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7092 - RNA, 9876 nt, Artificial Sequence
  derived and/or modified CDS sequence (wt) from DENV-2__KC131142__SS-prME
acugcagguauaauuauuauggugaucccaacagugauggcguuccauuuaaccacacgcaauggagaaccacacaugaucgucaguagacaagagaaagggaaaagucuucuauuuaaaacagagaacgguuugaacaugugcacccucauggccauggaccuuggugaacugugugaagacacaaucacuuacaauuguccucuucucaggcagaaugaaccagaagacauagacuguuggugcaacucuacgucuacauggguaacuuaugggacaugcacagcuacaggagaacacagaagggaaaaaagaucaguggcacucguuccacaugugggaaugggacuggagacacgaacugaaacauggaugucaucagaaggggccuggaaacaugcacagagaauugagaccugggucuugagacauccaggcuucaccauaauggcagcaauccuggcauacaccauaggaacgacauauuuccaaagaguccugauuuucaucuuacugacagcuaucgcuccuucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaagacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggaugggggaauggaugcggauuauuuggaaagggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacuccacagaguuccaucacagaagcagaacuaacaggcuauggcacuguuacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguuuuaggaucccaagaaggagcuaugcacacagcacucacaggggccacggaaauccagaugucaucaggaaacuuacuauucacaggacaucuuaaauguaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccagucaacauagaagcagaaccuccauucggagauagcuauaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauucucauaggagucgucaucacauggauaggaaugaauucacgcagcaccucacugucugugucacuaguauuagugggagucgugacauuguauuugggaguuauggugcaggccgauagugguugcguugugagcuggaaaaacaaagaacugaaauguggcagugggauuuuuaucacagacaacgugcacacauggacagaacaauacaaauuccaaccagaauccccuucaaagcuggcuucagcuauccagaaggcccaugaagaaggcauuuguggaauccgcucaguaacaagacuggagaaucugauguggaaacaaauaacaccagaacugaaucacauucuaucagaaaaugaggugaaguugaccaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagagguugaagauuauggcuuuggaguauucaccacuaacauauggcugaaauugaaagaaaggcaggauguauuuugugacucaaaacucaugucagcagccauaaaagacaacagagccguccacgccgacauggguuauuggauagaaagcgcacuaaaugacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaggacuguggaaauagaggacccucuuuaagaacaacuacugccucuggaaaacucauaacagaauggugcugccgaucuugcacauuaccaccgcuaagguacagaggugaggauggaugcugguauggaauggaaaucagaccauugaaagagaaagaagagaacuuggucaacuccuuggucacagccggacauggacagauugacaacuucucacuaggagucuugggaauggcauuguuccuggaagagaugcuuagaacccgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaggucagaccaacuuuugcagcuggacuacucuuaagaaagcugaccuccaaggaauugaugaugaccaccauaggaaucguacuccucucucagagcaccauaccagagacuauacuugaacuaacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacauuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaacgaggcuauuauggcagucgggauggugagcauuuuagccaguucucucuuaaagaaugacauucccaugacaggaccacuaguggcuggagggcuucucacuguguguuacgugcucacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacagacacugaccauacugauuagaacaggacugcuggugauaucaggacuguuucccgugucaauaccaaucacggcagcugcaugguaccugugggaagugaaaaagcaacgagccggaguauugugggaugucccuucaccuccaccugugggaaaggccgaacuggaagacggagccuauagaaucaagcagaaagggauucuaggauacucgcagauaggagccggagucuacaaagaaggaacauuccacacaauguggcaugucacacguggugcuguucuaaugcauaaagggaagagaauugaaccaucaugggcggacgucaagaaagaccuaauaucguauggaggaggcuggaaguuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggucuuuauggcaacggugucgucacaaggaguggaacauaugugagugccauagcucagacugaaaaaagcauugaagacaaccuagagauugaagaugacaucuuucgaaagaaaagauugaccgucauggaccuccacccaggagcaggaaaaacaaagagauaucuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcauacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucaggacaugaguggguuacggauuuuaaagggaagacuguuugguuuguuccaaguauaaaagcaggaaaugauauagcagcuugccugaggaagaauggaaagaaagugauacaacucagcaggaaaacuuuugauacugaauauauuaagacuaggaccaaugacugggacuuuguggucacgacagacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaguaggaagaaacccaaaaaaugaaaaugaccaguacauauacaugggggaaccucuggaaaaugaugaagacugcgcacacuggaaagaagcuaagaugcuucuagauaacaucaacacgccugaaggaaucauucccagcauguuugaaccagagcgugaaaaggucgacgccauugauggugaauaccgcuugagaggagaagcgaggaaaacauuuguggaccuaaugagaagaggggaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcgcucaaagaauucaaggaauucgcagcuggaagaaaaucccugacccugaaucuaaucaccgagauggguaggcucccaaccuucaugacccagaaagcaaggaaugcuuuggacaacuuagcaguccuacauacggcugaagcaggcggaagggcguacaaucaugcucuuagugaacugccggagacucuggagacauugcuucuacugacacuuuuggccacagucacgggcggaaucuuccuguucuugaugagcggaaaggguauagggaagaugacccugggaaugugcugcauaaucacagccaguauucuccuaugguaugcacaaauacagccacauuggauagcagcuucaauaauacuggaguuuuuucucauagucuugcucauuccagagccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucgaaaauggacaucggaguuccccuucuugcuauuggaugcuauucacaagucaaccccauaacccucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaacuuuagcgaccgggcccaucucuacacugugggaaggaaauccagggagauuuuggaacacaacuauugcagugucaauggccaacauuuuuagagggaguuaccuggccggagccggacuucucuuuucuaucaugaagaacacggccaacacaagaaggggaacuggcaacacaggagagacgcuuggagagaaauggaaaaaccgguugaacgcacuggggaagagugaauuccagaucuauaagaaaaguggaauccaggaaguggauagaacuuuagcaaaagaaggcaucaagagaggagaaacggaccaucacgcugugucgcgaggcucagcgaaacugagaugguucgucgagagaaaccuggucacaccagaagggaaaguaguggaccuuggcugcgguagggggggcuggucauacuauugugggggacuaaagaauguaaaagaagucaaaggccuaacaaaaggaggaccaggacacgaagaacccauucccaugucaacauaugguuggaaucuggugcgucuccaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucuuaacccauauaugccuucaguuauagaaaaaauggaagcgcuacaaaggaaauacggaggagcuuuagugaggaauccacucucacgaaauuccacacacgagauguacuggguauccaaugcuuccgggaacauagugucaucagugaacaugauuucaagaauguugauuaacagauucacaaugagacacaagaaggccacauacgagccggauguugaucucggaaguggaacccguaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaagcugcuaacaaaaccuugggacgucaucccuauggugacacagauggcaaugacagacacgacuccauuuggacaacagcgcguuuucaaagagaaaguggacacgagaacccaagaaccaaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacguggggcuguugaagacaguggauucugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuagguuucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggauuugaaaaaugaagaaauggugacaaaccacauggaaggaguacacaagaaacuugcugaagccauuuucagauuaacguaccaaaacaaaguggugcgugugcaaagaccgacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaucugacagucacagaagaaauugcagugaaaaacugguuaguaagaguggggcgugagagguuaucaagaauggccaucagcggagacgauuguguugugaaacccuuagaugacagguuugcaagcgcucuaacagcucuaaaugacaugggaaaggucaggaaagacauacaacaaugggaaccuucaagaggauggaacgauuggacacaagugcccuuuuguucacaccauuuccaugaguuaaucaugaaagacggucguguacuugugguuccauguagaaaccaagaugaacugauugguagggcccgaauuucccagggagccggguggucuuugcgggaaacagccuguuuggggaagucuuacgcccaaauguggagccuaauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacagaguguggauccaagaaaacccauggauggaagacaaaacuccaguagaaucaugggaggaaaucccauauuuggggaagagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7093 - RNA, 9876 nt, Artificial Sequence
  derived and/or modified CDS sequence (wt) from DENV-2__AY858035__SS-prME
acagcagguauaauuauuaugaugauuccaacagugauggcguuccauuuaaccacacgcaacggagaaccacacaugaucgucaguagacaagagaaggggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucacuauaauggcagcaauccuggcuuacaccauaggaacgacauauuuccaaagaguccugaucuucaucuuacugacagcugucgcucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaacuuggaauacaccauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcacacagcacucacaggggccacggaaauccagaugucaucaggaaacuuacuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgccugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugagguaaagcugacuaucaugacaggagacauuaaaggaaucaugcaggcaggaaaacgaucccugcggccucaacccacugagcugaaguacucuuggaaaacauggggcaaagcgaaaaugcucuccacagaacuccauaaccacaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuucgcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaacugaugaugaccaccauaggaaucgugcuccucucccagagcaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcauugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugguaucaggacucuuucccgugucaauaccaaucacggcagcugcaugguaccugugggaagugaaaaaacaacgagcaggaguauugugggaugucccuucacccccaccugugggaaaagccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaucuaauaucguauggaggaggcuggaagcuagaaggagaauggaaggaaggagaagaaguccagguccuggcauuagagcccggaaaaaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaaugcaccaaucauggaugaagaaagggaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauucugaauauauuaagacuaggaccaaugauugggacuuuguggucacgacagacauuucagaaaugggugcaaacuucaaggcugagagggucauagaccccagacgcuguaugaaaccagucauauuaacagacggugaagagcgggugaucuuggcaggacccaugccagugacccacucuagugcagcacaaagaagagggagaguaggaagaaauccaaaaaaugaaaaugaccaguacauauacaugggagaaccucuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcgaggaaaacuuuuguggaccuaaugagaagaggagaccuaccagucugguuagccuacaaaguggcagcugaagguaucaacuacgcagacagaagauggugcuuugauggagucaagaacaaccaaaucuuggaagaaaauguggaaguggaaauuuggacaaaagaaggagaaaggaagaaauuaaaaccuagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaucacgcucuuagugaacugccggagacucuggagacauugcucuuacugacucucuuggccacagucacgggcggaaucuuccuguucuugaugagcggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauucuucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuacugguagcacauuaugcuaucauagggccaggacuccaagcgaaagcaacuagagaagcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccgguugaauacauuggggaagagugaauuccagaucuauaagaaaaguggaauccaggaaguggauagaaccuuagcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacauugcuaugugacauaggggagucgucaccaaaccccacgguugaagcaggacgaacacucagaguucuaaacuuaguggaaaauuggcugaacaacaacacccaauuuugcauaaagguucucaacccauauaugcccucaguuauagaaaaaauggaagcgcuacaaaggaaauacggaggagcuuuggugaggaauccacucucacgaaauuccacacacgagauguacuggguauccaaugccuccgggaacauagugucaucagugaacaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacacguaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuggaggacuuaaaaaaugaagaaauggugacaaaccacauggaaggagaacacaagaaacuugcugaagccaucuucaaauuaacguaccaaaacaagguggugcgugugcaaagaccaacaccaagaggcacaguaauggacaucauaucgagaagagaccaaagagguagcggacaagucgucaccuacggccucaauacuuucaccaacauggaagcccaacugaucagacagauggagggagaaggagucuucaaaagcauccagcaacugacagucacagaagaaauugcagugaaaaacuggcuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 7094 - RNA, 9873 nt, Artificial Sequence
  derived and/or modified CDS sequence (wt) from DENV-2__JX567951__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagcuauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucgcccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauauguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagauuuuggaacaccaccauugcagugucaauggcuaacaucuuuagggggagcuacuuggccggagcuggacuucucuuuuccaucaugaagaacacgacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcucgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugcccuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugg

SEQ ID NO: 7095 - RNA, 9873 nt, Artificial Sequence
  derived and/or modified CDS sequence (wt) from DENV-2__JX567950__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcugcccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacaggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguaaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaagacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgccaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuuuuaacaacucuuucgagaaccagcaagaaaaggagcuggccgcuaaaugaagcuaucauggcagucgggauggugagcauuuuggccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaguaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuuccccccccccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcucacuucucagacccagcaagcauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauauuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcacacggcugagguagguggaaaggcguacacucaugcucucaaugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaauaccucggauugggaagcauuacaacccaggaaucugagagcaacauccuggacauagaucuacguccugcaucagcauggacgcuguaugccguggcuacaacauuugucacaccaauguugcgacauagcauuguaaauuccucaguaaaugucacauuaacagccauugcuaaccaagcuacagugcuaaugggucuugggaaaggauggccauugucaaagauggacaucggaguuccccuccuugccauuggaugcuacucacaagucaacccuauaacucucacagcugcucuucuuuuauugguagcccauuaugccauuauagggccaggccuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacugguaacguaggagagacacuuggagaaaaauggaaaagccgauuaaaugcacuggggaaaaaugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugacacauuguugugugacauaggggagucgucaccaaaucccacgauagaagcaggacgaacacucagaguccuuaacuuagcggaaaauugguugaacaacaacacccaauuuugcauaaagguucucaacccauauaugcccucagucauagaaaaaauggaaacacuacaaaggaaauauggaggagcuuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaaugugcaccagagaagaauucacaaggaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagagaacucccugaguggaguggaaggagaagggcugcacaggcuaggcuacauuuuaagagaugugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaggucgguaccuauggccuuaauacuuucaccaacauggaagcccaauuaauuagacagauggaaggagaaggaaucuucaaaagcauucagcaccugacagccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagguuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaaaucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugg

SEQ ID NO: 7096 - RNA, 9873 nt, Artificial Sequence
  derived and/or modified CDS sequence (wt) from DENV-2__HQ012538__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaacaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugaugguuauggugggcguuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacgucccuucacccccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucuuagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacacgagauguacuggguauccaaugcuaccgggaauauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagccgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugg

SEQ ID NO: 7097 - RNA, 9873 nt, Artificial Sequence
  derived and/or modified CDS sequence (wt) from DENV-2__HQ012533__SS-prME
acagcaggcgugauuauuauguugauuccaacagcaauggcguuccauuuaaccacacguaauggagaaccacacaugauuguugguaggcaagagaaagggaaaagucuucuguuuaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaagauugugaaggaaauagcagaaacacaacauggaacaauaguuaucagaguacaauaugaaggggacggcuccccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacuuaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaacaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugaugguuauggugggcguuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauccuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucuuagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacucugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacauaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugg

SEQ ID NO: 7098 - RNA, 9873 nt, Artificial Sequence
  derived and/or modified CDS sequence (wt) from DENV-2__HQ012534__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacacguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaacaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagcgagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugaugguuauguugggcguucccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuccucacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagcuggaguuuacaaagaaggaacauuccauacaauguggcacgucacacguggugcuguucugaugcauagagggaaaagaauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaaucuuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacaguuugguuuguuccaaguauaaaagcaggaaaugacauagcagcuugucuuagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacagaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaacaacaacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugg

SEQ ID NO: 7099 - RNA, 9873 nt, Artificial Sequence
  derived and/or modified CDS sequence (wt) from DENV-2__HQ012535__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacuuuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggccgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggaucuucauuacagauaacgugcacacguggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacauggacagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugaugguuauggugggcguuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagaaaccauucuugaacugacugaugcguuagcccugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccaguggaaaaagccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaauuccugagcgcucguggaauucaggacaugaaugggucacggauuuuaaagggaagacuguuugguuuguuccaaguauaaaagcaggaaaugacauagcagcuugucucagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuacuauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuagcggaaaauugguugaacaacaacacccaauuuugcauaaagguucucaacccauauaugcccucagucauagaaaaaauggaaacacuacaaaggaaauauggaggagcuuuagugaggaauccacucucacgaaacuccacacaugagauguacuggguauccaaugcuaccgggaacauagugucaucagugaauaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacgaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagaugugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggaaggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgcgaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugg

SEQ ID NO: 7100 - RNA, 9873 nt, Artificial Sequence
  derived and/or modified CDS sequence (wt) from DENV-2__HQ012536__SS-prME
acagcaggugugauuauuauguugauuccaacagcaauggcguuccauuuaaccacacguaauggagaaccacacaugaucguugguaggcaagagaaagggaaaagucuucuguuuaaaacagaggauggugucaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcagucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacgggggccacagaaauccagaugucaucgggaaacuuacuguucacaggacaucucaaguguaggcugagauuggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggacuuggaaaaaagacacgucuuaggucgccugauuacaguuaacccaaucguaacaggaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggacuuuggaucccugggaggaguauuuacaucuauaggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaauggcacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacaguaguggugacugaggacuguggaaauagaggacccuccuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuugguaaacuccuuggucacagccggacaugggcagauugacaacuuuucacuaggagucuugggaauggcacuguuucuggaagaaaugcucaggacccgaguaggaacaaaacaugcaauacugcuagucgcaguaucuuuugugacauugauuacugggaacauguccuuuaaagaccugggaagagugaugguuauggugggcguugccaugacggaugauauagguaugggagugacuuaccuugcccuacuagcagcuuucaaaguuagaccaacuuucgcagcuggacuacucuugagaaaacugaccuccaaggaauuaaugauggccaccauaggaaucacacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccgucucuccauugcuccuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaagaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccagugggaaaagccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaucuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaauggugucgucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcucacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucucagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaggguaucaacuacgcagacagaaggugguguuuugauggaaucaagaacaaccaaauacuggaagaaaacguggaaguggagaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagaugcacuggacaacuuagcugugcugcauacggcugaggcagguggaagggcguauaaucaugcucucagugaacugccggagacccuggagacacugcuuuuacugacacuccuggccacagucacaggaggaaucuucuuauucuuaaugagcggaaaaggcauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccacugucaaagauggacaucggaguuccccuccuugccauuggaugcuauucacaggucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccuuggcugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaacaacaacacccaauuuugcauaaaaguucucaacccauauaugccuucagucauagaaaaaauggaaacacuacaaaggaaauacggaggagcuuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcacgaauggaugacgacggaagauaugcuggcagucuggaauaggguguggauccaagaaaacccguggaugggagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucucuuauaggcaaugaggaauacacagacuacaugccauccaugaagagauucagaagggaagaggaagaggcagguguucugugg

SEQ ID NO: 7101 - RNA, 9873 nt, Artificial Sequence
  derived and/or modified CDS sequence (wt) from DENV-2__HQ012537__SS-prME
acagcaggcgugauuauuauguugauuccaacagcaauggcguuccauuugaccacacguaauggagaaccacacaugaucguugguaggcaagagaaagggaaaagucuucuguuuaaaacagaggacgguguuaacauguguacccucauggccauagaccuuggugaauugugugaagauacaaucacguacaaguguccccuccucaggcaaaaugaaccagaagacauagauuguuggugcaacuccacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguccagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacuuuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagagaaucuggaauacacuaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggacgucguuguuuuaggaucucaagaaggggccaugcacacggcacuuacaggggccacagaaauccagaugucaucaggaaacuuacuguuuacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggccgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggcgacacagccugggauuuuggaucccugggaggaguguuuacaucuauaggaaaggcucuccaccaaguuuucggagcaaucuauggggcugcuuuuaguggggucucauggacuaugaaaauccucauaggagucaucauuacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggaucuucauuacagauaacgugcacacguggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauuaaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacuuaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuuguacacuaccaccucuaagauacagaggugaggauggaugcugguacgggauggaaaucagaccauugaaagagaaagaggagaauuuggucaacuccuuggucacagccggacauggacagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccuaggaagagugaugguuauggugggcguuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagaaaccauucuugaacugacugaugcguuagcccuggguaugaugguccucagaauagugagaaauauggaaaaguaccaauuggcagugaccaucauggcuaucucgugugucccaaaugcagugauacuccuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccaguggaaaaggccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcgggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgaacacaccgggcgggagaucguggaccuaaugugucaugccacauucacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaagcagagacccauuuccucagagcaaugcaccaaucauggaugaggaaagagaaauuccugagcgcucguggaauucaggacaugaaugggucacggauuuuaaagggaagacuguuugguuuguuccaaguauaaaagcaggaaaugacauagcagcuugucucagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaauuugcggcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaacaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuagcauucuccuaugguaugcacagauacaaccacacuggauagcagcuucaauaauacuggaguuuuuccucauaguuuugcuuauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacguuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguguuaaugaugaggacuacaugggcucugugugaagcucuaacccuagcgaccgggcccaucuccacacugugggaaggaaauccagggagguuuuggaacacuacuauugcagugucaauggccaacaucuuuagggggagcuacuuggccggagcuggacuucuuuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggagagucgucaccaaaucccacgauagaagcaggacggacacucagaguccucaacuuagcggaaaauugguugaacaacaacacccaauuuugcauaaagguucucaacccauauaugcccucagucauagaaaaaauggaaacacuacaaaggaaauauggaggagcuuuagugaggaauccacucucacgaaacuccacacaugagauguacuggguauccaaugcuaccgggaacauagugucaucagugaauaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccacgguagcuaugaaacaaaacaaacuggaucagcaucaucuauggugaacggaguggucagacugcugacgaaaccuugggacgucgucccuauggugacacagauggcaaugacagacacgacuccauuuggacaacaacgcgucuucaaagagaaaguggacacgagaacucaagaaccgaaagagggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagaugugagcaagaaggaagggggagcaauguacgcugaugauacagcaggaugggacacaagaaucacacuagaggacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagcgggcaagucggcaccuauggccuuaacacuuucaccaacauggaagcccaauuaauuagacagauggaaggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgcgaccucagacuggcagcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugg

SEQ ID NO: 7102 - RNA, 9876 nt, Artificial Sequence
  derived and/or modified CDS sequence (wt) from DENV-2__KU365901__SS-prME
acugcagguauaauuauuaugaugauuccaacagugauggcguuccauuuaaccacacgcaacggagaaccacacaugaucgucaguagacaagagaaagggaaaagucuucuguucaaaacagagaacggugugaacauguguacccucauggccauggaccuuggugaacugugugaagacacaaucacuuauaacuguccucuucucaggcagaaugaaccagaagacauagacuguuggugcaacuccacgucuacauggguaacuuaugggacauguaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggccuacacuauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauuaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucuguaaacacuccaugguagacagaggauggggaaauggaugcggauuauuuggaaagggagguaucgugaccugugcaauguucacaugcaaaaagaacauggaaggaaaaaucgugcaaccagaaaacuuggaguacaccauugugauaacaccucacucaggggaggagaaugcagucggaaaugacacaggaaaacacggcaaggaaauuaaaguaacaccacagaguuccaucacagaagcagaacuaacaggcuauggcaccgucacgauggagugcucuccgagaacgggccucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggacguugucguuuuaggaucccaagaaggggcuaugcacacagcacucacaggggccacggaaauccagaugucaucaggaaacuuacuguucacaggacaucuuaagugcaggcugagaauggacaaacuacagcucaaaggaaugucauauuccauguguacaggaaaguuuaaaguugugaaggaaauagcagaaacacaacauggaacaauagucaucagaguacaauaugaaggggacgguucuccguguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaaaaaaggaaguucuauuggccaaauguuugagacaacaaugagaggagcgaagagaauggccauuuuaggugacacagcuugggauuuuggauccuugggagggguguucacauccauaggaaaagcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaggaacugaaauguggcagugggauuuuuaucacagacaauguacacacauggacagaacaauacaaauuccaaccagaauccccuucaaagcuggcuucagcuauccagaaggcucacgaagaaggcauuugcggaauccgcucaguaacaagacuggagaaucugauguggaaacaaauaacacaagaacugaaucacauucuaucagaaaaugaggugaaguugacuaucaugacaggagacauuaaaggaaucaugcaggcaggaaaacgaucccugcggccucaacccacugagcugaaguacucuuggaaaacaugggggaaagcgaaaaugcucuccacagaacuucauaaccacaccuuucucauugauggccccgaaacagcagaaugucccaacacaaacagagcuuggaacucacuagaaguugaagacuauggcuuuggaguauucaccaccaacauauggcugaaauugaaagaaaagcaggauguauuuugugacucaaaacucaugucagcagccauaaaagacaacagagccguccacgccgauauggguuauuggauagaaagcgcacucaaugacacauggaagauugagaaagccucuuucauugaaguuaaaagcugcaacuggccaaagucacacacucucuggaguaauggaguguuagaaagugagaugauaauuccaaaaaauuuugcaggaccagugucacaacacaauuacagaccaggcuaucacacacaaacggcaggacccuggcaccuaggcaggcuugagauggacuuugaauucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccacugaaagagaaagaagagaacuuggucaacucuuuagucacagccggacauggacagauugacaacuucucacugggagucuugggaauggcacuguuccuggaagagaugcucaggacccgagugggaacgaaacaugcaauauuacuaguugcaguuacuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuucgcagcuggacuacucuuaagaaagcuaaccuccaaggaauugaugauggccaccauaggaaucgugcuccucucccagagcaccauaccggagaccauacuugaacugacugaugcguuggcuuuggggaugaugguucucaaaauagugagaaacauggaaaaguaucaacuagcagugacuaucauggccaucuugugcguccccaaugcagugauauuacaaaacgcauggagagugagcugcacaacacuggcagugguguccguuuccccacugcuuuuaacauccucacagcagaaagcggauuggauaccacuggcguugacgaucaaaggucuuaauccaacagccauuuucuuaacaacccucucaagaacuagcaagaaaaggagcuggccacuaaaugaggcuauuauggcagucgggauggugagcauuuuagccaguucccuccuaaagaaugauauucccaugacaggaccauuaguggcuggagggcuucucacuguguguuacguacucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugauaucaggacuuuuucccgugucaauaccaaucacggcagcugcaugguaccugugggaagugaaaaaacaacgagcaggaguauugugggauguccccucacccccaccugugggaaaggccgaacuggaagauggagcauauagaaucaagcagaaagggauucuaggauacucgcagaucggagccggaguuuacaaagaaggaacauuccacacaauguggcaugucacacguggugcugucuuaaugcauaaagggaagagaauugaaccaucaugggcggacgucaagaaagaccuaauaucguauggaggaggcuggaagcuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaaugguguuguuacaaggaguggaacauaugugagugccauagcccagacugaaaaaagcaucgaagacaauccagagauugaagaugacaucuuucgaaagaaaagauuaaccaucauggaccuccacccaggagcaggaaaaacaaagagauaccuuccagcaauagucagagaagccauaaaacgaggccugagaacacuaauccuggcccccacuagaguuguggcggcugaaauggaagaagcucucagaggacuuccaauaagauaccaaaccccagcuaucagagcugagcacacugggcgggagaucguggaucuaaugugucaugccacauuuaccaugaggcuacuaucaccaauuagagugccaaauuacaaccugauuaucauggaugaagcccauuucacagacccagcaagcauagcagccagaggauacauuucaacucgaguagagaugggugaagcagcugggauuuucaugacagcuaccccuccuggaagcagagacccauuuccucagagcaaugcaccaaucauggaugaagaaagggaaaucccugagcguucauggaacucuggacaugaguggguuacggauuuuaaagggaaaacuguuugguuuguuccaagcauaaaagcagggaaugacauagcagcuugccugagaaagaauggaaagaaagugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacggacggugaagagcgggugaucuuggcaggacccaugccagugacccacucuagugcagcacaaagaagagggagaguaggaagaaauccaaaaaaugaaaaugaucaguacauauacaugggggaaccucuggaaaaugaugaagacugugcacacuggaaagaagcuaaaaugcuucuagacaacaucaacacaccugaaggaaucauucccagcauguucgagccagagcgugaaaagguggaugccauugauggugaauaccgcuugagaggagaagcgagaaaaacuuuuguggaccuaaugagaagaggagaccuaccagucugguuagcuuacagaguggcagcugaagguaucaacuacgcagacagaagauggugcuuugauggagucaagaacaaccaaaucuuggaagaaaauguggaaguggaaauuuggacaaaagaaggagaaagaaagaaauuaaaacccagauggcuggaugcuaggaucuacucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaccaugcucuuagugaacugccggagacucuggaaacauugcuuuuacugacacucuuggccacagucacgggcggaauuuuccuguucuugaugaguggaaaagguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaacauccuggacauagauuuacguccugcaucagcuuggacucuguaugccguggcaacaacuuucaucacaccaauguugaggcauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuauuaugaagaacacggccaacacaagaaggggaacuggcaacacaggagagacgcuuggagaaaaauggaaaaaccgguugaaugcauuggggaagagugaauuccagaucuauaagaaaaguggaauccaggaaguggauagaaccuuagcaaaagaaggcaucaaaagaggagaaacagaccaccacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugaugucuuuuuuacuccgccagaaaagugugauacauugcugugugacauaggggagucgucaccaaaccccacgguugaagcaggacgaacacucagaguucuaaacuuaguggaaaauuggcugaacaacaacacccaauuuugcauaaagguucucaacccauauaugcccucaguuauagagaaaauggaagcgcuacaaaggaaauacggaggagcuuuggugaggaauccacucucacgaaauuccacacacgagauguacuggguauccaaugcuuccgggaacauagugucaucagugaauaugauuucaagaauguugaucaacagauucacaaugagacacaagaaggccacauacgagcccgauguugaccucggaagugggacccgcaacaucggaauugaaagugagacaccaaauuuagacauaauugggaaaagaauagaaaaaauaaaacaagagcaugaaacaucauggcauuaugaccaagaucacccauacaaaacgugggccuaccauggcagcuacgaaacaaaacagaccggaucagcaucauccauggugaacggagugguuaggcugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaggaaaaagacaccuaggaugugcaccagagaagaauucacaagaaaggugagaaguaaugcagccuuaggcgccauauucacugaugagaacaaguggaagucggcacgugaggcuguugaagacaguggauucugggaauugguugacaaggaaaggaaucuccaucuugaaggaaagugugagacauguguguauaacaugaugggaaagagagagaagaagcuaggggaguucgguaaagcgaaaggcagcagagcuauaugguacauguggcuuggagcacgcuucuuagaguuugaagcccuaggauucuugaacgaagaucacugguuuuccagagagaacucccugaguggaguggaaggagaagggcugcacaaacuaggcuacauuuuaagagacgugaguaagaaagaaggaggagcaauguacgccgaugacaccgcaggaugggauacaagaaucacauuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacaucauaucgagaagagaccaaagagguagcggacagguugucaccuacggccucaauacuuucaccaacauggaagcccaacugaucagacagauggagggagaaggagucuucaaaagcauccagcaacugacagucacagaagaaauugcagugaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuugcucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcagcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaagucagaucccuaauaggcaaugaggaauacacagacuacaugccauccaugaaaagauuuagaagagaagaggaagaggcaggagucuugugguag

SEQ ID NO: 7103 - RNA, 9876 nt, Artificial Sequence
  derived and/or modified CDS sequence (wt) from DENV-2__GQ398258__SS-prME
acugcaggcaugauuaucauguugauuccaacagugauggcguuccauuuaaccacacgcaacggagaaccacacaugaucgucaguagacaagagaaagggaaaagucuucuguuuaaaacagaggauggugugaacauguguacccucauggccauggaccuuggugaauugugugaagacacaaucacuuauaauuguccucuccucaggcagaaugaaccagaagacauagacuguuggugcaacuccacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuuggaucuugagacauccaggcuuuaccauaauggcagcaaucuuggcauacaccauaggaacgacauauuuucaaagaguccugauuuucaucuugcugacagcugucgcuccuucaaugacaaugcguuguauaggaauaucaaauagagacuuuguggaagggguuucaggaggaagcuggguugacauagucuuagaacauggaagcugugugacgacgauggcaaaaaauaaaccaacauuggauuuugaacugauaaaaacagaagccaaacaacccgccacucuaaggaaguauugcauagaggcaaagcugaccaauacaacaacagcaucucgcugcccaacacaaggggaacccagccuaaaugaagagcaggacaaaagguucguuugcaaacauuccaugguagacagaggauggggaaauggaugcggauuauuuggaaagggaggcaucgugaccugugcuauguucacaugcaaaaagaacauggaaggaaaagucgugcaaccagaaaacuuggaauacaccauugugauaacaccucacucaggggaagagaaugcaguuggaaaugacacagggaaacacggcaaggaaaucaaaauaacaccacagaguuccaucacagaagcagaacugacaggcuauggcacugucacgauggagugcucuccgagaacgggccucgacuucaaugagaugguguugcugcaaauggaaaacaaagcuuggcuggugcacagacaaugguuccuagaccugccguuaccauggcugcccggagcggacacacaaggaucaaauuggauacagaaggagacauuggucacuuucaaaaauccucaugcgaagaaacaggauguuguuguuuuaggaucccaagaaggggcuaugcauacagcacuuacaggggccacggaaauccagaugucaucaggaaacuuacuguucacaggacaucucaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccaugcaagaucccuuuugagauaauggauuuggaaaaaagacaugucuuaggucgccugauuacagucaacccaauaguuacagaaaaagacagcccagucaacauagaagcagaaccuccauucggagacagcuacaucauuauaggaguagaaccgggacaacugaagcucaacugguuuaagaaaggaaguucuaucggccaaauguuugagacaacaaugagaggagcgaagagaauggccauuuuaggugacacagccugggauuuuggaucccugggaggaguguucacaucuauaggaaaggcucuccaccaaguuuuuggagcaauuuauggggcugccuucaguggggucucauggacuaugaaaauccucauaggaguugucauuacauggauaggaaugaauucacgcagcaccucacugucugugucacuaguauuagugggagucgugacauuguaucugggaguuauggugcaggccgauagugguugcguugugaguuggaaaaacaaagaacugaaauguggcagugggauuuuuaucacagacaacguacacacauggacagaacaauacaaauuccaaccagaaucuccuucaaagcuggcuucagcuauccagaaagcucaugaagaaggcauuuguggaauccgcucaguaacaagacuggagaaucuaauguggaaacaaauaacaccagaacugaaucacauucuaucagaaaaugagguaaaguugacuaucaugacaggagacauuaaaggaaucaugcaggcaggaaaacgauccuugcggccucagcccacugagcugaaguauucauggaaaacauggggcaaagcgaaaaugcucuccacagagcuucauaaccagaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacccaaaacucaugucagcggccauaaaagacaacagagccguccaugccgauauggguuauuggauagaaagcgcacuuaaugacacauggaagauagagaaagccucuuuuaucgaaguuaaaagcugccacuggccaaagucacauacucucuggaguaauggagugcuagaaagcgagaugauaauuccaaagaauuuugcuggaccagugucacaacacaacuacagaccaggcuaucacacacaaacggcaggacccuggcaucuagguaagcuugagauggacuuugauuucugcgaaggaaccacagugguggugacugaggacugugggaauagaggacccucuuuaagaacaacuaccgccucuggaaaacucauaacagaauggugcugccgaucuugcacauuaccaccgcuaagauacaaaggugaggauggauguugguacgggauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagaccuggggagagugaugguuauggugggugccacuaugacggaugacauaggcaugggcgugacuuaucuugcccuacuagcagccuucaaaguuagaccaacuuuugcagcuggacuacucuugagaaagcugaccuccaaggaauugaugaugaccaccauaggaaucguacuccucucucagagcaccauaccagagacuauacuugaacugacugaugcguuggcucuggggaugaugguccucaaaauagugaaaaauauggaaaaauaucaauuagcagugacuaucauggcuaucuuaugcgucccaaaugcagugauauuacaaaacgcauggaaagugaguugcacaauauuggcagugguguccguuucuccacugcucuuaacauccucacagcagaaagcggauuggauaccauuggcauugacgaucaaaggccucaauccaacagccauuuucuuaacaacccuuucaagaacuagcaagaaaaggagcuggccacuaaaugaggcuaucauggcagucgggauggugagcauuuuagccaguucucucuuaaagaaugauauucccaugacaggaccacuaguggcuggagggcuucucacuguguguuacgugcucacuggaagaucggccgauuuggaacuggagagggccgccgauguaagaugggaagaucaggcagagauaucaggaagcaguccaauucugucaauaacaauaucggaagaugguagcaugucgauaaaaaaugaagaggaagaacaaacacugaccauacucauuagaacaggacugcuggugauaucaggacuuuuucccguaucaauaccaaucacggcagcagcaugguaccugugggaagugaagaaacaacgggcuggaguauugugggaugucccuucacccccacccgugggaaaggccgaacuggaagauggagccuauagaaucaagcagaaagggauucuuggauacucccagaucggagccggaguuuacaaagaaggaacauuccacacgauguggcacguuacacguggugcuguucuaaugcauaaagggaagagaauugaaccaucaugggcggacgucaagaaagaccuaauaucguauggaggaggcuggaagcuagaaggagaauggaaagaaggagaagaaguccaggucuuggcauuagagccuggaaagaauccaagagccguccaaacaaaacccggucuuuucaaaacuaacaccggaaccauaggcgcuguaucucuggacuuuucuccuggaacgucaggaucuccaaucgucgacaaaaaaggaaaaguugugggucuuuauggcaauggugucgucacaaggaguggaacauaugugagugccauagcccagacugaaaaaagcauugaagacaauccagagauugaagaugacaucuuucgaaagaaaagauugaccauuauggaccuccacccaggagcgggaaagacgaagagauaccuuccagcaauagucagagaggccauaaaacgaggcuugagaacauuaauccuggcccccacuagaguuguggcagcugaaauggaggaagcucuuagaggacuuccaauaagauaccaaaccccagccaucagagcugagcacacugggcgggagauuguggaucuaaugugccacgccacauuuaccaugaggcugcuaucaccaguuagagugccaaauuacaaccugaucaucauggaugaagcccauuucacagacccagcaagcauagcagcuagaggauacauuucaacucgaguagagaugggugaagcagcugggauuuucaugacagccacuccuccgggaagcagagacccauuuccucagagcaaugcaccaaucauggaugaagaaagggaaaucccugaacguucguggaauucuggacaugaguggguuacggauuuuaaagggaagacuguuugguuuguuccaaguauaaaagcaggaaaugauauagcagcuugccugagaaaaaauggaaagaaagugauacaacucaguaggaagaccuuugauucugaauauaucaagacuaggaccaaugauugggacuucguggucacgacugacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugacggugaauaccgcuuaagaggagaagcgaggaaaaccuuuguggacuuaaugagaagaggagaccuaccagucuggcuggccuacagaguggcagcugaagguaucaacuacgcagacagaaggugguguuuugauggaaucaagaacaaccaaaucuuggaagaaaauguggaaguggaaauuuggacaaaagaaggggaaaggaagaaauuaaaacccagaugguuggaugcuaggaucuauucugacccgcuggcgcucaaagaauucaaggaauucgcagcuggaagaaagucccugacccugaaucuaaucacagagauggguaggcuuccaacuuucaugacucagaaagcaaggaacgcacuggacaacuuagcaguccugcauacggcugaagcaggcggaagggcguacaaucaugcucuuagugaacugccggagacccuggagacauugcuuuuacugacacuuuuggcuacagucacgggcggaaucuuccuauucuugaugagcggaaaggguauagggaagaugacccugggaaugugcugcauaaucacggccaguauucuccuaugguacgcacaaauacagccacacuggauagcagcuucaauaauacuggaguuuuuucucauagucuugcuuauuccagaaccagaaaagcagagaacaccccaagacaaccaauuaacuuacguugucauagccauccucacaguaguggcugcaaccauggcaaacgagauggguuuccuggaaaaaacgaagaaagauuucggauugggaagcauugcuacccaccaacccgagagcaacauccuggacauagaucuacguccugcaucagcauggacucuguaugccguggccacaacauucaucacaccaauguugagacauagcauugaaaauuccucagugaaugugucccuaacagccauugccaaccaagccacaguguuaaugggucuugggaaaggauggccauugucaaaaauggacaucggaguuccccuucucgccauugggugcuauucacaagucaaccccauaacucucacagcagcccuucuuuuauugguagcacauuaugcuaucauagggccaggacuccaagcgaaagcaaccagagaagcucagaaaagagcagcagcgggcaucaugaaaaacccaacuguagauggaauaacagugauugaccuagauccaauacccuaugauccaaaguuugaaaagcaguugggacaaguaaugcuccuaguccucugcgugacucaaguauugaugaugaggacuacaugggcuuugugugaggcucuaacccuagcgaccgggcccaucuccacauugugggaaggaaauccagggagauuuuggaauacaaccauugcagugucaauggcuaacauuuuuagagggaguuacuuggccggagcuggacuccucuucucuaucaugaagaacacagccaacacaagaagaggaacuggcaacacaggagagacgcuuggagagaaauggaaaaaccgauugaaugcauuggggaagagugaauuccagaucuacaagaaaaguggaauccaggaaguggauagaaccuuagcaaaagaaggcauuaaaagaggagaaacggaccaucacgcugugucgcgaggcucagcaaaauugagaugguucgucgagagaaaccuggucacaccagaggggaagguaguggaccucgguugcggcagagggggcuggucauacuauugugggggacuaaagaauguaagagaaguuaaaggccuaacaaaaggaggaccaggacacgaagaacccauucccaugucaacauauggguggaaucuggugcgucuucaaaguggaguugauguuuuuuuuacuccgccagaaaagugugacacauugcugugugauauaggggagucgucaccaaaucccacgguugaagcaggacgaacacucagagucuuaaacuuaguggaaaauuggcugaacaacaacacccaauuuugcauaaagguucucaacccauacaugcccucagucauagaaaaaauggaagcgcuacaaaggaaauauggaggagcuuuggugaggaauccacucucacgaaauuccacacaugagauguacuggguauccaaugcuuccgggaauauagugucaucagugaacaugauuucaaggauguugauuaacagauuuacaaugagacauaagaaggccacauacgagccagauguugaccucggaagcggaacccgcaacaucggaauugaaagugagacaccaaauuuagacauaauuggaaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuagacugcugacaaaaccuugggacgucaucccuauggugacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugaaacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggauauuauaucgagaagagaccaaagagguaguggacaaguuggcaccuauggccucaauacuuucaccaauauggaagcccaacuaaucagacagauggagggagaaggagucuucaaaagcauccagcaccugacagucacagaagaaauugcagugcaaaacuggcuagcaagaguggggcgugagagguuaucaagaauggccaucaguggagaugauuguguugugaaaccuuuagaugacagguuugccagcgcuuuaacagcucuaaaugauaugggaaagguuaggaaagacauacaacaaugggaaccuucaagaggauggaacgacuggacacaagugcccuuuuguucacaccacuuccaugaguuaaucaugaaagacggucguguacucguaguuccauguagaaaccaagaugaacugauugguagagcccgaauuucccagggagccggguggucuuugcgggagacggccuguuuggggaagucuuacgcccaaauguggagccugauguacuuccacagacgugaccucaggcuggcggcaaaugcuauuugcucggcagucccaucacauuggguuccaacaagccgaacaacuugguccauacacgccagacaugaauggaugacaacggaagacaugcugacagucuggaacaggguguggguucaagaaaacccauggauggaagacaaaacuccaguggaaucaugggaggaaaucccauaccuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuuaugguag

SEQ ID NO: 7104 - RNA, 9876 nt, Artificial Sequence
  derived and/or modified CDS sequence (wt) from DENV-2__GQ398259__SS-prME
acugcaggcaugauuaucauguugauuccaacagugauggcguuccauuuaaccacacgcaacggagaaccacacaugaucgucaguagacaagagaaagggaaaagucuucuguuuaaaacagaggauggugugaacauguguacccucauggccauggaccuuggugaauugugugaagacacaaucacuuauaauuguccucuccucaggcagaaugaaccagaagacauagacuguuggugcaacuccacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuuggaucuugagacauccaggcuuuaccauaauggcagcaaucuuggcauacaccauaggaacgacauauuuucaaagaguccugauuuucaucuugcugacagcugucgcuccuucaaugacaaugcguuguauaggaauaucaaauagagacuuuguggaagggguuucaggaggaagcuggguugacauagucuuagaacauggaagcugugugacgacgauggcaaaaaauaaaccaacauuggauuuugaacugauaaaaacagaagccaaacaacccgccacucuaaggaaguauuguauagaggcaaagcugaccaauacaacaacagcaucucgcugcccaacacaaggggaacccagccuaaaugaagagcaggacaaaagguucguuugcaaacauuccaugguagacagaggauggggaaauggaugcggauuauuuggaaagggaggcaucgugaccugugcuauguucacaugcaaaaagaacauggaaggaaaagucgugcaaccagaaaacuuggaauacaccauugugauaacaccucacucaggggaagagaaugcaguuggaaaugacacagggaaacacggcaaggaaaucaaaauaacaccacagaguuccaucacagaagcagaacugacaggcuauggcacugucacgauggagugcucuccgagaacgggccucgacuucaaugagaugguguugcugcaaauggaaaacaaagcuuggcuggugcacagacaaugguuccuagaccugccguuaccauggcugcccggagcggacacacaaggaucaaauuggauacagaaggagacauuggucacuuucaaaaauccucaugcgaagaaacaggauguuguuguuuuaggaucccaagaaggggcuaugcauacagcacuuacaggggccacggaaauccagaugucaucaggaaacuuacuguucacaggacaucucaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccaugcaagaucccuuuugagauaauggaucuggaaaaaagacaugucuuaggucgccugauuacagucaacccaauaguuacagaaaaagacagcccagucaacauagaagcagaaccuccauucggagacagcuacaucauuauaggaguagaaccgggacaacugaagcucaacugguuuaagaaaggaaguucuaucggccaaauguuugagacaacaaugagaggagcgaagagaauggccauuuuaggugacacagccugggauuuuggaucccugggaggaguguucacaucuauaggaaaggcucuccaccaaguuuuuggagcaauuuauggggcugccuucaguggggucucauggacuaugaaaauccucauaggaguugucauuacauggauaggaaugaauucacgcagcaccucacugucugugucacuaguauuagugggagucgugacauuguaucuaggaguuauggugcaggccgauagugguugcguugugaguuggaaaaacaaagaacugaaauguggcagugggauuuuuaucacagacaacguacacacauggacagaacaauacaaauuccaaccagaaucuccuucaaagcuggcuucagcuauccagaaagcucaugaagaaggcauuuguggaauccgcucaguaacaagacuggagaaucuaauguggaaacaaauaacaccagaacugaaucacauucuaucagaaaaugagguaaaguugacuaucaugacaggagacauuaaaggaaucaugcaggcaggaaaacgauccuugcggccucagcccacugagcugaaguauucauggaaaacauggggcaaagcgaaaaugcucuccacagagcuucauaaccagaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcggccauaaaagacaacagagccguccaugccgauauggguuauuggauagaaagcgcacuuaaugacacauggaagauagagaaagccucuuuuaucgaaguuaaaagcugccacuggccaaagucacauacucucuggaguaauggagugcuagaaagcgagaugauaauuccaaagaauuuugcuggaccagugucacaacacaacuacagaccaggcuaucauacacaaacggcaggacccuggcaucuagguaagcuugagauggacuuugauuucugcgaaggaaccacagugguggugacugaggacugugggaauagaggacccucuuuaagaacaacuaccgccucuggaaaacucauaacagaauggugcugccgaucuugcacauuaccaccgcuaagauacaaaggugaggauggauguugguacgggauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagaccuggggagagugaugguuauggugggugccacuaugacggaugacauaggcaugggcgugacuuaucuugcccuacuagcagccuucaaaguuagaccaacuuuugcagcuggacuacucuugagaaagcugaccuccaaggaauugaugaugaccaccauaggaaucguacuccucucucagagcaccauaccagagacuauacuugaacugacugaugcguuggcucuggggaugaugguccucaaaauagugaaaaauauggaaaaauaucaauuagcagugacuaucauggcuaucuuaugcgucccaaaugcagugauauuacaaaacgcauggaaagugaguugcacaauauuggcagugguguccguuucuccacugcucuuaacauccucacagcagaaagcggauuggauaccauuggcauugacgaucaaaggccucaauccaacagccauuuucuuaacaacccuuucaagaacuagcaagaaaaggagcuggccacuaaaugaggcuaucauggcagucgggauggugagcauuuuagccaguucucucuuaaagaaugauauucccaugacaggaccacuaguggcuggagggcuucucacuguguguuacgugcucacuggaagaucggccgauuuggaacuggagagggccgccgauguaagaugggaagaucaggcagagauaucaggaagcaguccaauucugucaauaacaauaucggaagaugguagcaugucgauaaaaaaugaagaggaagaacaaacauugaccauacucauuagaacaggacugcuggugauaucaggacuuuuucccguaucaauaccaaucacagcagcagcaugguaccugugggaagugaagaaacaacgggcuggaguauugugggaugucccuucacccccacccgugggaaaggccgaacuggaagauggagccuauagaaucaagcagaaagggauucuuggauacucccagaucggagccggaguuuacaaagaaggaacauuccacacgauguggcacguuacacguggugcuguucuaaugcauaaagggaagagaauugaaccaucaugggcggacgucaagaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggcgcuguaucucuggacuuuucuccuggaacgucaggaucuccaaucgucgacaaaaaaggaaaaguugugggucuuuauggcaauggugucgucacaaggaguggaacauaugugagugccauagcccagacugaaaaaagcauugaagacaauccagagauugaagaugacaucuuucgaaagaaaagauugaccauuauggaccuccacccaggagcgggaaagacgaagagauaccuuccagcaauagucagagaggccauaaaacgaggcuugagaacauuaauccuggcccccacuagaguuguggcagcugaaauggaggaagcucuuagaggacuuccaauaagauaccaaaccccagccaucagagcugagcacacugggcgggagauuguggaucuaaugugccacgccacauuuaccaugaggcugcuaucaccaguuagagugccaaauuacaaccugaucaucauggaugaagcccauuucacagacccagcaagcauagcagcuagaggauacauuucaacucgaguagagaugggugaagcagcugggauuuucaugacagccacuccuccgggaagcagagacccauuuccucagagcaaugcaccaaucauggaugaagaaagggaaaucccugaacguucguggaauucuggacaugaguggguuacggauuuuaaagggaagacuguuugguuuguuccaaguauaaaagcaggaaaugauauagcagcuugccugagaaaaaauggaaagaaagugauacaacucaguaggaagaccuuugauucugaauauaucaagacuaggaccaaugauugggacuucguggucacgacugacauuucagaaaugggugcuaacuucaaggcugagaggguuauagaccccagacgcugcaugaaaccagucauacuaacagacggugaagagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugacggugaauaccgcuuaagaggagaagcgaggaaaaccuuuguggacuuaaugagaagaggagaccuaccagucuggcuggccuacagaguggcagcugaagguaucaacuacgcagacagaaggugguguuuugauggaaucaagaacaaccaaaucuuggaagaaaauguggaaguggaaauuuggacaaaagaaggggaaaggaagaaauuaaaacccagaugguuggaugcuaggaucuauucugacccgcuggcgcucaaagaauucaaggaauucgcagcuggaagaaagucccugacccugaaucuaaucacagagauggguaggcuuccaacuuucaugacccagaaagcaaggaacgcacuggacaacuuagcaguccugcauacggcugaagcaggcggaagggcguacaaucaugcucuuagugaacugccggagacccuggagacauugcuuuuacugacacuuuuggcuacagucacgggcggaaucuuccuauucuugaugagcggaaaggguauagggaagaugacccugggaaugugcugcauaaucacggccaguauucuccuaugguacgcacaaauacagccacacuggauagcagcuucaauaauacuggaguuuuuucucauagucuugcuuauuccagaaccagaaaagcagagaacaccccaagacaaccaauuaacuuacguugucauagccauccucacaguaguggcugcaaccauggcaaacgagauggguuuccuggaaaaaacgaagaaagauuucggauugggaagcauugcuacccaccaacccgagagcaacauccuggacauagaucuacguccugcaucagcauggacucuguaugccguggccacaacauucaucacaccaauguugagacauagcauugaaaauuccucagugaaugugucccuaacagccauugccaaccaagccacaguguuaaugggucuugggaaaggauggccauugucaaaaauggacaucggaguuccccuucucgccauugggugcuauucacaagucaaccccauaacucucacagcagcccuucuuuuauugguagcacauuaugcuaucauagggccaggacuccaagcgaaagcaaccagagaagcucagaaaagagcagcagcgggcaucaugaaaaacccaacuguagauggaauaacagugauugaccuagauccaauacccuaugauccaaaguuugaaaagcaguugggacaaguaaugcuccuaguccucugcgugacucaaguauugaugaugaggacuacaugggcuuugugugaggcucuaacccuagcgaccgggcccaucuccacauugugggaaggaaauccagggagauuuuggaauacaaccauugcagugucaauggcuaacauuuuuagagggaguuacuuggccggagcuggacuccucuucucuaucaugaagaacacagccaacacaagaagaggaacuggcaacacaggagagacgcuuggagagaaauggaaaaaccgauugaaugcauuggggaagagugaauuccagaucuacaagaaaaguggaauccaggaaguggauagaaccuuagcaaaagaaggcauuaaaagaggagaaacggaccaucacgcugugucgcgaggcucagcaaaauugagaugguucgucgagagaaaccuggucacaccagaggggaagguaguggaccucgguugcggcagagggggcuggucauacuauugugggggacuaaagaauguaagagaaguuaaaggccuaacaaaaggaggaccaggacacgaagaacccauucccaugucaacauauggguggaaucuggugcgucuucaaaguggaguugauguuuuuuuuacuccgccagaaaagugugacacauugcugugugauauaggggagucgucaccaaaucccacgguugaagcaggacgaacacucagagucuuaaacuuaguggaaaauuggcugaacaacaacacccaauuuugcauaaagguucucaacccauacaugcccucagucauagaaaaaauggaagcgcuacaaaggaaauauggaggagcuuuggugaggaauccacucucacgaaauuccacacaugagauguacuggguauccaaugcuuccgggaauauagugucaucagugaacaugauuucaaggauguugauuaacagauuuacaaugagacauaagaaggccacauacgagccagauguugaccucggaagcggaacccgcaacaucggaauugaaagugagacaccaaauuuagacauaauuggaaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuagacugcugacaaaaccuugggacgucaucccuauggugacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacagcagauuuugggaacugguggacaaggaaaggaaucuccaucuugaaggaaagugugaaacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggauauuauaucgagaagagaccaaagagguaguggacaaguuggcaccuauggccucaauacuuucaccaauauggaagcccaacuaaucagacagauggagggagaaggagucuucaaaagcauccagcaccugacagucacagaagaaauugcagugcaaaacuggcuagcaagaguggggcgugagagguuaucaagaauggccaucaguggagaugauuguguugugaaaccuuuagaugacagguuugccagcgcuuuaacagcucuaaaugauaugggaaagguuaggaaagacauacaacaaugggaaccuucaagaggauggaacgacuggacacaagugcccuuuuguucacaccacuuccaugaguuaaucaugaaagacggucguguacucguaguuccauguagaaaccaagaugaacugauugguagagcccgaauuucccagggagccggguggucuuugcgggagacggccuguuuggggaagucuuacgcccaaauguggagccugauguacuuccacagacgugaucucaggcuggcggcaaaugcuauuugcucggcagucccaucacauuggguuccaacaagccgaacaacuugguccauacacgccagacaugaauggaugacaacggaagacaugcugacagucuggaacaggguguggguucaagaaaacccauggauggaagacaaaacuccaguggaaucaugggaggaaaucccauaccuggggaaaagagaagaccaauggugcggcucauuaauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7105 - RNA, 9876 nt, Artificial Sequence
  derived and/or modified CDS sequence (wt) from DENV-2__GQ398268__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacauguguacccucauggccauggaccuuggugaauugugugaagauacaaucacguacaaguguccucuucucaggcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggauuauuuggaaaaggaggcauugugaccugugcuauguucacaugcaaaaagaacauggaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaauguuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaauggagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacugcucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacgggaggaaucuuuuuauucuugaugagcggaagggguauagggaagaugacccugggaauguguugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuucucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucgggagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 7106 - RNA, 9876 nt, Artificial Sequence
  derived and/or modified CDS sequence (wt) from DENV-2__GQ398263__SS-prME
acugcaggcaugauuaucaugaugauuccaacagugauggcguuccauuuaaccacacgcaacggagaaccacacaugaucgucaguagacaagagaaagggaaaagucuucuguuuaaaacagaggauggugugaacauguguacccucauggccauggaccuuggugaauugugugaggacacaaucacuuauaauuguccucuucucaggcagaaugaaccagaagacauagacuguuggugcaauucuacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcaaaaaacaaaccaacauuagauuuugaacugauaaaaacagaagcuaaacaucccgccacucuaaggaaguauuguauagaggcaaagcugaccaacacaacaacagcaucucgcugcccaacacaaggggaaccuagccuaaaugaagagcaggacaaaagguucgucugcaaacauuccaugguagacagaggauggggaaauggaugcggacuauuuggaaagggaggcaucgugaccugugcaauguucacaugcaaaaagaacauggaaggaaaagucgugcaaccagaaaacuuggaauacaccauugugauaacaccucacucaggggaagagaaugcagucggaaaugacacaggaaaacacggcaaggaaauuaaaauaacaccacagaguuccaucacagaagcagaacugacaggcuauggcacugucacgauggaaugcucuccgagaacgggccucgacuucaaugagaugguguugcugcaaauggaaaacaaggcuuggcuggugcacaggcaaugguuccuagaccugccguuaccauggcugcccggagcggacacacaaggaucaaauuggauacagaaggagacauuggucacuuucaaaaauccccaugcgaagaaacaggauguuguuguuuuaggaucccaagaaggggcuaugcauacagcacuuacaggggccacggaaauccagaugucaucaggaaacuuacuguucacaggacaucucaagugcaggcugagaauggacaaacuacagcucaaaggaaugucauauucuauguguacaggaaaguucaaaguugugaaggaaauagcagaaacacaacauggaacaauaguugucagaguacaauaugaaggggacgguucuccgugcaagaucccuuuugaaauaauggauuuggaaaaaagacaugucuuaggucgccugauuacagucaacccaauuguuacagaaaaagacagcccagucaacauagaagcagaaccuccauucggagacagcuacaucauuauaggaguagaaccgggacaacugaagcucagcugguuuaagaaaggaaguucuaucggccaaauguuugagacaacaaugagaggagcgaagagaauggccauuuuaggugacacagcuugggauuuuggaucccugggaggaguguucacaucuauaggaaaggcucuccaccaaguuuuuggagcaaucuauggggcugccuucaguggggucucauggacuaugaaaauccucauaggaguugucaucacauggauaggaaugaauucacgcagcaccucacugucugugucacuaguauuagugggggucgugacauuguauuugggaguuauggugcaggccgauaguggcugcguugugaguuggaaaaacaaagaacugaaauguggcagugggauuuuuaucacagacaacguacacacauggacagaacaauacaaauuccaaccagaauccccuucaaaguuggcuucagcuauccagaaagcucaugaagagggcauuuguggaauccgcucagugacaagacuggagaaucugauguggaaacagauaacaccagaacugaaucacauucuaucagaaaaugagguaaaguugacuaucaugacaggagacauuaaaggaaucaugcaggcaggaaaacgaucccugcggccucagcccacugagcugaaguauucauggaaaacauggggcaaagcgaaaaugcucuccacagagcuucauaaccacaccuuucucauugauggccccgaaacagcagaaugucccaccacaaacagagcuuggaacucacuagaaguugaagacuauggcuuuggaguauucaccacuaacauauggcugaaauugaaagaaaggcaggauguacuuugugacucaaaacucaugucagcggccauaaaagacaacagggccguccaugccgauaugggcuauuggauagaaagugcacuuaaugacacauggaagauugagaaagccucuuuuaucgaaguuaaaagcugccacuggccaaagucacacacccucuggaguaauggagugcuagaaagugagaugauaauuccaaagaauuuugcuggaccaguaucacaacacaacuauagaccaggcuaucacacacaaacggcaggacccuggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccguuaagguacagaggugaggauggaugcugguacgggauggaaaucagaccauugaaagauaaagaagagaacuuagucaacucuuuggucacagccggacauggacagauugacaacuucucacuaggagucuugggaauggcauuguuccuggaagaaaugcucaggacccgaguaggaacgaaacaugcaauacuacuaguugcaguuucuuucgugacauugaucacagggaacauguccuuucgagacuuggggagagugaugguuauggugggcgcuacuaugacggaugacauaggcaugggugugacuuaucuugcccuauuagcagccuucaaagucagaccaacuuuugcagcuggacuacucuugagaaagcugaccuccaaggaauugaugaugaccaccauaggaaucguacuccucucucagagcaccauaccagagacuauacuugaacugacugaugcguuggcuuuggggaugaugguccucaaaauagugagaaauauggaaaaguaucaauuagcagugacuaucauggccaucuugugcgucccaaacgcagugauauuacaaaacgcauggaaagugaguugcacaauacuggcagugguguccguuuccccacugcucuuaacauccucacagcagaaagcggauuggauaccacuagcauugacgaucaaaggccucaauccaacagccauuuuccuaacaacccucucaagaacuagcaagaaaaggagcuggccacuaaaugaggcuauuauggcagucgggauggugagcauuuuagccaguucucuuuuaaagaaugauauucccaugacaggaccauuaguggcuggagggcuucucacuguguguuaugugcucacuggaagaucggccgauuuggaacuggagagagccgcugacguaagaugggaagaucaggcagagauaucaggaaguaguccaauucugucaauaacaauaucggaagaugguagcaugucgauaaaaaaugaggaggaagaacaaacacugaccauacucauuagaacaggacugcuggugauaucaggacuuuuucccgugucaauaccaaucacggcagcagcaugguaccugugggaagugaagaaacaacgagcuggaguauugugggaugucccuucacccccaccugugggaaaggccgaacuggaagauggagccuacagaaucaagcagaaagggauucuuggauacucccagaucggagccggaguuuacaaagaaggaacauuccacacaauguggcacgucacacguggugcuguucuaaugcacaaagggaagagaauugaaccaucaugggcggacguuaggaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggcgccguaucucuggacuuuucuccuggaacgucaggaucuccaaucgucgacaaaaaaggaaaaguugugggccuuuauggcaauggugucgucacaaggaguggaacauaugugagugccauagcccagacugaaaaaagcauugaagacaauccagagauugaagaugacaucuuucgaaagaaaagauugaccaucauggaccuccacccaggagcgggaaagacgaagagauaccuuccagcaauagucagagaggccauaaaacgaggcuugagaacauuaauccuggcccccacuagaguuguggcggcugaaauggaggaagcucucagaggacuuccaauaagauaccaaaccccagcuaucagagcugagcacacugggcgggagauuguggaucuaaugugucacgccacauuuaccaugaggcugcuaucaccaguuagagugccaaauuacaaccugaucaucauggaugaagcccauuucacagacccagcaagcauagcagcuagaggauacauuucaacucgaguagagaugggugaagcagcugggauuuucaugacagccacuccuccgggaagcagagauccauuuccucagagcaaugcaccaaucauggaugaagaaagggaaaucccugaacguucguggaauucuggacaugaguggguuacggauuuuaaagggaaaacuguuugguuuguuccaagcauaaaagcaggaaacgauauagcagcuugucugaggaaaaauggaaagaaagugauacaacucagcaggaagaccuuugauucugaauauaucaagacuaggaccaaugauugggacuucguggucacgacagacauuucugaaaugggugcuaacuucaaggcugagaggguuauagaccccagacgcugcaugaaaccagucauacuaacagacggugaagagcgggugauccuggcaggacccaugccagugacccauucuagugcagcacaaagaagagggagaauaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuuaagaggagaagcgaggaaaacuuuuguggaccuaaugagaagaggagaccuaccagucuggcuggccuacagaguggcagcugaagguaucaacuacgcagacagaaggugguguuuugauggaaucaagaacaaccaaaucuuggaagaaaauguggaaguggaaauuuggacaaaagaaggagaaaggaagaaauuaaaaccuagaugguuggaugcuaggaucuacucugacccacuggcgcucaaagaauucaaggaauucgcagcuggaagaaagucccugacccugaaucuaaucacagagauggguaggcuuccaaccuucaugacucagaaagcaaggaacgcacuggacaacuuagcaguccugcauacggcugaagcaggcggaagggcguacaaucaugcucuuagugaacugccggagacccuggagacauugcucuuacugacacuuuuggccacagucacgggcggaaucuuucuauucuugaugagcggaaaggguauagggaagaugacccugggaaugugcugcauaaucacggccaguauucuccuaugguacgcacaaauacagccacacuggauagcagcuucaauaauacuggaguuuuuucucauagucuugcuuauuccagaaccagaaaagcagagaacaccccaagauaaccaauuaacuuauguugucauagccauccucacagugguggccgcaaccauggcaaacgagauggguuuccuggaaaaaacgaagaaagauuucggauugggaagcauugcaacccagcaaccugagagcaacauccuggacauagaucuacguccugcaucagcauggacuuuauaugccguggcaacaacauucaucacaccaauguugagacauagcauugaaaauuccucagugaaugugucucuaacagcuauugccaaccaagccacaguguuaaugggucuugggaaaggauggccauugucaaaaauggacaucggaguuccccuucuugccauugggugcuauucacaagucaaccccauaacucucacagcagcccuucuuuuacugguagcacauuaugcuaucauagggccaggacuccaagcgaaagcaaccagagaagcucaaaaaagagcagcagcgggcaucaugaaaaacccaacuguggauggaauaacagugauugaccuagauccaauacccuaugauccaaaguuugaaaagcaguugggacaaguaaugcuccuaguccucugcgugacccaaguauugaugaugaggacuacaugggcuuugugugaggcucuaaccuuagcgaccgggcccaucuccacauugugggaaggaaauccagggagauuuuggaauacaacuauugcagugucaauggcuaacauuuuuagagggaguuacuuggccggagccggacuucucuuuucuaucaugaagaacacagccaacacaagaaggggaacuggcaacacaggagagacgcuuggagagaaauggaaaaaccgauugaaugcauuggggaagagugaauuccagaucuauaagaaaagcggaauccaggaaguggauagaacccuagcaaaagaaggcauuaaaagaggagaaacggaccaccacgcugugucgcgaggcucggcgaaacugagaugguucgucgagagaaaccuggucacaccagaggggaaaguaguggaccucggcugcggcagagggggcuggucauacuacugugggggacuaaagaauguaaaagaagucaaaggccuaacaaaaggaggaccaggacacgaagaacccauucccaugucaacauauggguggaaucuggugcgucuucaaaguggaguugauguuuuuuuuacuccgccagaaaagugugacacauugcugugugacauaggagagucgucaccaaaucccacgguugaggcaggacgaacacucagaguuuuaaacuuaguggaaaauuggcugaacaacaacacccaauuuugcauaaagguucucaacccauacaugcccucagucauagaaaaaauggaagcgcugcaaaggaaauauggaggagcuuuggugaggaauccacucucacgaaauuccacacaugagauguacuggguauccaaugcuuccgggaauauagugucaucagugaacaugauuucaaggauguugauuaauagauuuacaaugagacauaagaaggccacauacgagccagauguugaccucggaagcggaacccgcaacaucggaauugaaagugagauaccaaauuuagacguaauuggaaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacuaggaaagaaaaagacaccuaggaugugcaccagagaagaauucacaagaaaggugagaagcaaugcagcccuaggugccauauacacugaugagaacaaguggaagucggcacgugaggcuguugaagauagcagauuuugggaacugguugacaaggaaaggaaucuccaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacauaagaaacuugcugaggccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaauuaaucagacagauggagggagaaggagucuucaaaagcauccagcaccugacagucacagaagaaauugcagugaaaaacugguuagcaagaguggggcgugagagguuaucaagaauggccaucaguggagaugauuguguuguaaaaccuuuagaugacagguuugcaagcgcuuuaacagcucuaaaugacaugggaaaaguuaggaaagacauacaacaaugggaaccuucaagaggauggaacgauuggacacaagugcccuuuuguucacaccauuuccaugaguuaaucaugaaagacggucguguacucguaguuccauguagaaaccaagaugaacugauugguagagcccgaauuucccagggagccggguggucuuugcgggagacagccuguuuggggaagucuuacgcccaaauguggagccugauguacuuccacagacgugaccuuaggcuggcggcaaaugcuauaugcucggcagucccaucacauuggguuccaacaagucgaacaaccuggucuauacacgccacacaugaauggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuauaugccauccaugaaaagauucagaagagaagaggaagaggcaggagucuugugguag

SEQ ID NO: 7107 - RNA, 9876 nt, Artificial Sequence
  derived and/or modified CDS sequence (wt) from DENV-2__GQ398264__SS-prME
acugcaggcaugauuaucaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaauugugugaagacacaaucacuuauaauuguccucuucucaggcagaaugaaccagaagacauagacuguuggugcaacucuacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcaaaaaauaaaccaacauuggauuuugaacugauaaaaacagaagccaaacaucccgccacucuaaggaaguauuguauagaggcaaagcugaccaacacaacaacagcaucucgcugcccaacacaaggggaaccuagccuaaaugaagagcaggacaaaagguuugucugcaaacauuccaugguagacagaggauggggaaauggaugcggauuauuuggaaagggaggcaucgugaccugugcaauguucacaugcaaaaagaacauggaaggaaaagucgugcaaccagaaaacuuggaauacaccauugugauaacaccucacucaggggaagagaaugcagucggaaaugacacaggaaaacacggcaaggaaauuaaaauaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcggacacacaaggaucaaauuggauacagaaggagacauuggucacuuucaaaaauccccaugcgaagaaacaggauguuguuguuuuaggaucccaagaaggggcuaugcauacagcacuuacaggggccacggaaauccagaugucaucaggaaacuuacuguucacaggacaucucaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgccugauuacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcucuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacgugcacacauggacagaacaauacaaauuccaaccagaauccccuucaaagcuggcuucagcuauccagaaggcucaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucagcccacugagcugaaguauucauggaaaacauggggcaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcggccauaaaagacaacagagccguccaugccgauaugggcuauuggauagaaagcgcacuuaaugacacauggaugauugagaaagccucuuuuaucgaaguuaaaagcugccacuggccaaagucacacacucucuggaguaauggagugcuagaaagugagaugauaauuccaaagaauuuugcaggaccagugucacaacacaacuacagaccaggcuaucauacacaaacggcaggacccuggcagcuagguaagcuugagauggacuuugauuucugcgaaggaaccacagugguggugacugaggauuguggaaauagaggacccucuuuaagaacaacuacugccucuggaaaacucauaacagaauggugcugccgaucuugcacauuaccaccgcuaagguacagaggugaggauggauguugguacgggauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagauuuggggagagugaugguuauggugggcgcuacuaugacggaugacauaggcaugggcgugacuuaucuugcccuauuagcagccuucaaagucagaccaacuuuugcagcuggacuacucuugagaaagcugaccuccaaggaauugaugaugaccaccauaggaaucguacuccucucucagagcaccauaccagagacuauacuugaacugacugaugcguuggcuuuggggaugaugguccucaaaauagugagaaacauggaaaaguaucaauuagcagugacuaucauggccaucuugugcgucccaaaugcagugauauuacaaaacgcauggaaagugagcugcacaacacuggcagugguguccguuuccccacugcucuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguagcuggagggcuccucacuguguguuacgugcucacuggaagaucggccgauuuggaacuggagagagccgcugacguaagaugggaagaucaggcagagauaucaggaaguaguccaauucugucaauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaagugaagaaacaacgagccggaguauugugggaugucccuucacccccaccugugggaaaggcugaacuggaagauggagccuacagaaucaagcagaaagggauucuuggauacucccagaucggagccggaguuuacaaagaaggaacauuccauacaauguggcacgucacacguggugcuguucuaaugcauaaagggaagagaauugaaccaucaugggcggacguuaggaaagaccuaauaucguauggaggaggcuggaaguuagaaggagaauggaaggaaggagaagaaguccagguccuggcauuagagccuggaaagaauccaagagccguccaaacaaaacccggucuuuucaaaacuaacacuggaaccauaggcgccguuucucuggacuuuucuccuggaacgucaggaucuccaaucgucgacaaaaaaggaaaaguugugggccuuuauggcaauggugucgucacaaggaguggaacauaugugagugccauagcccagacugaaaaaagcauugaagacaauccagagauugaagaugacaucuuucgaaagaaaagauugaccaucauggaccuccacccaggagcgggaaagacgaagagauaccuuccagcaauagucagagaagccauaaaacgaggcuugagaacauuaauccuggcccccacuagaguuguggcggcugaaauggaggaagcucucagaggacuuccaauaagauaccaaaccccagcuaucagagcugagcacacugggcgggagauuguggaucuaaugugucacgccacauuuaccaugaggcugcuaucaccaguuagagugccaaauuacaaccugaucaucauggaugaagcccauuucacagacccagcaagcauagcagcuagaggauacauuucaacucgaguagagaugggugaagcagcugggauuuucaugacagcuacuccuccgggaagcagagacccauuuccucagagcaaugcaccaaucauggaugaagaaagggaaaucccugagcguucguggaauucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuucguggucacgacagacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuuaagaggagaagcgaggaaaacuuuuguggaccuaaugagaagaggagaccuaccagucuggcuggccuacagaguggcagcugaagguaucaacuacgcagacagaaggugguguuuugauggagucaagaacaaccaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacucagaaagcaaggaacgcacuggacaacuuagcaguccugcauacggcugaagcaggcggaagggcguacaaucaugcucuuagugaacugccggagacccuggagacauugcuuuuacugacacuuuuggccacagucacgggcggaaucuuccuauucuugaugagcggaaaggguauagggaagaugacccugggaaugugcugcauaaucacggccaguauucuccuaugguacgcacaaauacagccacacuggauagcagcuucaauaauacuggaguuuuuucucauagucuugcucauuccagaaccagaaaagcagagaacaccccaagauaaccaauuaacuuauguugucauagccauccucacagugguggccgcaaccauggcaaacgagauggguuuccuggaaaaaacaaagaaagauuucggauugggaagcacugcaacccagcaaccugagagcaacauccuggacauagaucuacguccugcaucagcuuggacucuauaugccguggcaacaacuuucaucacaccgauguugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaagcucagaaaagagcagcagcgggcaucaugaaaaacccaacuguggauggaauaacagugauugaccuagauccaauacccuaugauccaaaguuugaaaagcaguugggacaaguaaugcuccuaguccucugcgugacucaaguauugaugaugaggacuacaugggcuuugugugaagcucuaaccuuagcgaccgggcccaucucuacauugugggaaggaaauccagggagauuuuggaauacaacuauugcagugucaauggcuaacauuuuuagagggaguuacuuggccggagccggacuucucuuuucuaucaugaagaacacggccaacacaagaaggggaacuggcaacacaggagagacgcuuggagagaaauggaaaaaccgauugaaugcauuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccucggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaucccacgguugaggcaggacgaacacucagaguucuaaacuuaguggaaaauuggcugaacaacaacacccaauuuugcauaaagguucucaacccauauaugcccucagucauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagacaccaaauuuagacauaauuggaaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagauaguggauuuugggaacugguugacaaggaaaggaaucuccaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggauauuauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccauguagaaaccaagaugaacugauugguagggcccgaauuucccagggagccggguggucuuugcgggaaacagccuguuuggggaagucuuacgcccaaauguggagccugauguacuuccacagacgugaccuuaggcuggcggcaaaugcuauuugcucggcagucccaucacauuggguuccaacaagucgaacaaccugguccauacacgccacacaugaauggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuauaugccauccaugaaaagauucagaagagaagaggaagaggcaggagucuugugguag

SEQ ID NO: 7108 - RNA, 9876 nt, Artificial Sequence
  derived and/or modified CDS sequence (wt) from DENV-2__GQ398260__SS-prME
acugcaggcaugauuaucauguugauuccaacagugauggcguuccauuugaccacacgcaacggagaaccacacaugaucgucaguagacaagagaaagggaaaagucuucuguuuaaaacagaggauggugugaacauguguacccucauggccauggaucuuggugaauugugugaagacacaaucacuuauaauuguccucuucucaggcagaaugaaccagaagacauagacuguuggugcaacuccacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuuggaucuugagacauccaggcuuuaccauaauggcagcaaucuuggcauacaccauaggaacgacauauuuucaaagaguccugauuuucaucuugcugacagcugucgcuccuucaaugacaaugcguuguauaggaauaucaaauagagacuuuguggaagggguuucaggaggaagcuggguugacauagucuuagagcauggaagcugugugacgacgauggcaaaaaauaaaccgacauuggauuuugaacugauaaaaacagaagccaaacaacccgcuacucuaaggaaguauuguauagaggcaaagcugaccaacacaacaacagcaucucgcugcccaacacaaggggaacccagccuaaaugaagagcaggacaaaagguucgucugcaaacauuccaugguagacagaggauggggaaauggaugcggauuauuuggaaagggaggcaucgugaccugugcuauguucacaugcaaaaagaacauggaaggaaaagucgugcaaccagaaaacuuggaauacaccauugugauaacaccucacucaggggaagagaaugcagucggaaaugacacaggaaaacacggcaaggaaaucaaaauaacaccacagaguuccaucacagaagcagaacugauaggcuauggcacugucacgauggaguguucuccgagaacgggccucgacuucaaugagaugguguugcugcaaauggaaaacaaagcuuggcuggugcacagacaaugguucuuagaccugccguuaccauggcugcccggagcggacacacaaggaucaaauuggauacaaaaggagacauuggucacuuucaaaaauccucaugcgaagaaacaggauguuguugucuuaggaucccaagaaggggcuaugcauacagcacuuacaggggccacggaaauccagaugucaucaggaaacuuacuguucacaggacaccucaagugcaggcugagaauggacaaacuacagcucaaaggaaugucauauucuauguguacaggaaaguuuaaaguugugaaggaaauagcagaaacacaacacggaacaauaguuaucagaguacaauaugaaggggacgguucuccaugcaagaucccuuuugagauaauggauuuggaaaaaagacaugucuuaggucgcuugauuacagucaacccaauuguuacagaaaaagacagcccagucaacauagaagcagaaccuccauucggagacagcuacaucauuauaggaguagaaccgggacaacugaagcucaacugguucaagaaaggaaguucuaucggccaaauguuugagacaacaaugagaggagcgaagagaauggccauuuuaggugacacagccugggauuucggaucccugggaggaguguucacaucuauaggaaaggcucuccaccaaguuuuuggagcaauuuauggggcugccuucaguggggucucauggacuaugaaaauccucauaggaguugucauuacauggauaggaaugaauucacgcagcaccucacucucugugucacuaguauuagugggagucgugacauuguauuugggaguuauggugcaggccgauagugguugcguugugaguuggaaaaacaaagaacugaaauguggcagugggauuuuugucacagacaacguacacacauggacagaacaauacaaauuccaaccagaaucuccuucaaagcuggcuucagcuauccagaaagcucaugaagaaggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgauccuugcggccucagcccacugagcugaaguauucauggaaaacuuggggcaaagcgaaaaugcucucuacagagcuucauaaccagaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcggccauaaaagacaacagagccguccaugccgauauggguuauuggauagaaagcgcacucaaugacacauggaagauagagaaagccucuuuuaucgaaguuaaaagcugccacuggccgaagucacauacucucuggaguaauggagugcuagaaagcgagaugauaauuccaaagaauuuugcuggaccagugucacaacacaacuacagaccaggcuaucacacacaaacggcaggacccuggcaucuagguaagcuugagauggacuuuaauuucugcgaaggaacuacagugguggugaccgaggacugugggaauagaggacccucuuuaagaacaacuaccgccucuggaaaacucauaacagaauggugcugccgaucuugcacauuaccaccgcuaagauacagaggugaggauggauguugguacgggauggaaaucagaccauugaaagagaaagaagaaaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuuugugacauugaucacagggaacauguccuuucgagaccuggggagagugaugguuauggugggugccacuaugacggaugacauaggcaugggcgugacuuaucuugcccuacuagcagccuucaaaguuagaccaacuuuugcagcuggacuacucuugagaaagcugaccuccaaggaauugaugaugaccaccauaggaaucguacuccucucucagagcaccauaccagagacuauacuugaacugacugaugcguuggcucuggggaugaugguccucaaaauagugagaaauauggaaaaguaucaauuagcagugacuaucauggcuaucuugugcgucccaaaugcagugauauuacaaaacgcauggaaagugaguugcacaauacuggcagugguguccgucucuccacugcucuuaacauccucacagcagaaagcggauuggauaccauuggcauugacgaucaaaggccucaauccaacagccauuuucuuaacaacccuuucaagaacuagcaagaaaaggagcuggccacuaaaugaggcuaucauggcagucgggauggugagcauuuuagccaguucucucuuaaagaaugauauccccaugacaggaccacuaguggcuggagggcuucucaccguguguuacgugcucacuggaagaucggccgauuuggaacuggagagggccgccgacgugagaugggaagaucaggcagagauaucaggaagcaguccaauucugucaauaacaauaucggaagaugguagcaugucgauaaaaaaugaagaggaagaacaaacacugaccauacucauuagaacaggacugcuggugauaucaggacuuuuucccguaucaauaccaaucacggcagcagcaugguaccugugggaagugaagaaacaacgggcuggaguauugugggaugucccuucacccccacccgugggaaaggccgaacuggaagauggagcuuauagaaucaagcagaaagggauucuuggauacucccagaucggagccggaguuuacaaagaaggaacauuccacacgauguggcacguuacacguggugcuguucuaaugcauaaaggaaagagaauugaaccaucaugggcggacgucaagaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggcgccgugucucuggacuuuucuccuggaacgucaggaucuccaaucgucgacaaaaaaggaaaaguugugggucuuuauggcaauggugucgucacaaggaguggaacauaugugagugccauagcccagacugaaaaaagcauugaagacaauccagagauugaagaugacaucuuucgaaagaaaagauugaccauuauggaccuccacccaggagcgggaaagacgaagagauaccuuccagcaauagucagagaggcuauaaaacgaggcuugagaacauuaauccuggcccccacuagagucguggcagccgaaauggaggaagcucuuagaggacuuccaauaagauaccaaaccccagccaucagagcugagcacacugggcgggagauuguggaucuaaugugccacgccacauuuaccaugaggcugcuaucaccaguuagagugccaaauuacaaccugaucaucauggaugaagcccauuucacagacccagcaagcauagcagcuagaggauacauuucaacucgaguagagaugggugaagcagcugggauuuucaugacagccacuccuccgggaagcagagacccauuuccucagagcaaugcaccaaucauggaugaagaaagggaaaucccugaacguucguggaauucuggacaugaguggguuacggacuuuaaagggaagacuguuugguuuguuccaaguauaaaagcaggaaaugauauagcagcuugccugagaaaaaauggaaagaaagugauacaacucaguagaaagaccuuugauucugaauauaucaagacuaggaccaaugauugggacuucguggucacgacugacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugugcacauuggaaagaagcuaagaugcuucuagauaacaucaacacgccugaaggaaucauucccagcauguucgaaccagagcgugaaaagguggaugccauugauggugaauaccgcuuaagaggagaagcgaggaaaaccuuuguggaccuaaugagaagaggagaccuaccagucuggcuggccuacagaguggcagcugaagguaucaacuacgcagacagaaggugguguuuugauggaaucaagaacaaccaaaucuuggaagaaaauguggaaguggaaauuuggacaaaagaaggggaaaggaagaaauuaaaacccagaugguuggaugcuaggaucuauucugacccgcuggcgcucaaagaauucaaggaauucgcagcuggaagaaagucccugacccugaaucuaaucacagagauagguaggcuuccaacuuucaugacucagaaagcaaggaacgcacuggacaacuuagcaguccugcauacagcugaagcaggcggaagggcauacaaucaugcucuuagugaacugccggagacccuggagacauugcuuuuacugacacuuuuggcuacagucacgggcggaaucuuucuauucuugaugagcggaaaggguauagggaaaaugacccugggaaugugcugcauaaucacggccaguauucuccuaugguacgcacaaauacaaccacacuggauagcagcuucaauaauacuggaguuuuuucucauagucuugcuuauuccagaaccagaaaagcagagaacaccccaagacaaccaauuaacuuacguugucauagccauccucacagugguagcugcaaccauggcaaacgagauggguuuccuggaaaaaacgaagaaagauuucggauugggaagcauugcaacccagcaacccgagagcaacauccuggacauagaucuacguccugcaucagcauggacucuguaugccguggccacaacauucaucacaccaauguugagacauagcauugaaaauuccucagugaauguuucccuaacagcuauugccaaccaagccacaguguuaaugggucuugggaaaggauggccauugucaaaaauggacaucggaguuccccuucucgccauugggugcuauucacaagucaaccccauaacucucacagcagcccuucuuuuauugguagcacauuaugcuaucauagggccaggacuccaagcgaaagcaaccagagaagcucagaaaagagcagcagcgggcaucaugaaaaacccaacuguagauggaauaacagugauugaccuagauccaauacccuaugauccaaaguuugagaagcaguugggacaaguaaugcuccuaguccucugcgugacucaaguauugaugaugaggacuacaugggcuuugugugaggcucuaacccuagcgaccgggcccaucuccacauugugggaaggaaacccagggagauuuuggaauacaacuauugcagugucaauggcuaacauuuuuagagggaguuacuuggccggagcuggacuccucuuuucuaucaugaagaauacagccaacacaagaaggggaacuggcaacacaggagagacgcuaggagagaaauggaaaaaccgauugaaugcauuggggaagagugaauuccagaucuacaagaaaaguggaauucaggaaguggauagaaccuuagcaaaagaaggcauuaaaagaggagaaacggaccaucacgcugugucgcgaggcucagcaaaacugagaugguucgucgagagaaaccuggucacaccagaggggaaaguaguggaccucgguugcggcagagggggcuggucauacuauugugggggacuaaagaauguaagagaagucaaaggccuaacaaaaggaggaccaggacacgaagaacccauucccaugucaacauauggguggaaucuggugcgucuucaaaguggaguugauguuuuuuuuacuccgccagaaaagugugacacauugcugugugacauaggggagucgucaccaaaucccacgauugaagcaggacgaacacucagagucuuaaacuuaguggaaaauuggcugaacaacaacacccaauuuuguauaaagguucucaacccauacaugcccucagucauagaaaaaauggaagcgcuacaaaggaaauacggaggagcuuuggugaggaauccacucucacgaaauuccacacaugagauguacuggguuuccaaugcuuccgggaacauagugucaucagugaacaugauuucaaggauguugauuaacagauuuacaaugagacauaagaaggccacauacgagccagauguugaccucggaagcggaacccgcaacaucggaauugaaagugagacaccaaacuuagacauaauuggaaaaagaauagaaaaaauaaaacaagagcaugaaacaucauggcacuaugaccaagaccacccauacaaaacgugggccuaccauggcagcuacgaaacaaaacagaccggaucagcaucauccauggugaacggaguaguuagauugcugacaaaaccuugggacgucaucccuacggugacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugaaacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagaugugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacgguaauggauauuauaucgagaagagaccaaagagguaguggacaaguuggcaccuauggucucaauacuuucaccaauauggaagcccaacuaaucagacagauggagggagaaggagucuucaaaagcauccagcaccugacagucacagaagaaauugcagugcaaaacuggcuagcaagaguggggcgugagagguuaucaagaauggccaucaguggagaugauuguguugugaaaccuuuagaugacagguuugcaagcgcucuaacagcucuaaaugacaugggaaagguuaggaaagacauacaacaaugggaaccuucaagaggauggaacgacuggacacaagugccuuuuuguucacaccacuuccaugaguuaaucaugaaagacggucguguacucguaguuccauguagaaaccaagaugaacugauugguagagcccgaauuucacagggagccggguggucuuugcgggagacggccuguuuggggaagucuuacgcccaaauguggagccugauguacuuccacagacgugaccucaggcuggcggcaaaugcuauuugcucggcagucccaucacauuggguuccaacaagucgaacaaccugguccauacacgccagacaugaauggaugacaacggaagacaugcugacagucuggaacaggguguggauucaagaaaacccauggauggaagacaaaacuccaguggaaucaugggaggaaaucccauaccuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7109 - RNA, 9876 nt, Artificial Sequence
  derived and/or modified CDS sequence (wt) from DENV-2__GQ398262__SS-prME
acugcaggcaugauuaucauguugauuccaacagugauggcguuccauuugaccacacgcaacggagaaccacacaugaucgucaguagacaagagaaagggaaaagucuucuguuuaaaacagaggauggugugaacauguguacccucauggccauggaucuuggugaauugugugaagacacaaucacuuauaauuguccucuucucaggcagaaugaaccagaggacauagacuguuggugcaacuccacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuuggaucuugagacauccaggcuuuaccauaauggcagcaaucuuggcauacaccauaggaacgacauacuuucaaagaguccugauuuucaucuugcugacagcugucgcuccuucaaugacaaugcguuguauaggaauaucaaauagagacuuuguggaagggguuucaggaggaagcuggguugacauagucuuagaacauggaagcugugugacgacgauggcaaaaaauaaaccaacauuggauuuugaacugauaaaaacagaagccaaacaacccgcuacucuaaggaaguacuguauagaggcaaagcugaccaacacaacaacagcaucucgcugcccaacacaaggggaacccagccuaaaugaagagcaggacaaaagguucgucugcaaacauuccaugguagacagaggauggggaaauggaugcggauuauuuggaaagggaggcaucgugaccugugcuauguucacaugcaaaaagaacauggaaggaaaagucgugcaaccagaaaaccuggaauacaccauugugauaacaccccacucaggggaagagaaugcagucggaaaugacacaggaaaacacggcaaggaaaucaaaauaacaccacagaguuccaucacagaagcagaacugacaggcuauggcacugucacgauggagugcucuccgagaacgggccucgacuuuaaugagaugguguugcugcaaauggaaaacaaagcuuggcuggugcacagacaaugguucuuagaccugccguuaccauggcugcccggagcggacacacaaggaucaaauuggauacagaaggagacauuggucacuuucaaaaauccucaugcgaagaaacaggauguuguuguuuuaggaucccaagaaggggcuaugcauacagcacuuacaggggccacggaaauucagaugucaucaggaaacuuacuguucacaggacaucucaagugcaggcugagaauggacaaauuacagcucaaaggaaugucauauucuauguguacaggaaaguuuaaaguugugaaggaaauagcagaaacacaacauggaacaauaguuaucagaguacaauaugaaggggacgguucuccaugcaagauuccuuuugagauaauggauuuggaaaaaagacaugucuuaggucgccugauuacagucaacccaauuguuacagaaaaagacagcccagucaacauagaagcagaaccuccauucggagacagcuacaucauuauaggaguagaaccgggacaacugaagcucaacugguuuaagaaaggaaguucuaucggucaaauguuugagacaacaaugagaggagcgaagagaauggccaucuuaggugacacagccugggauuuuggaucccugggaggaguguucacaucuauaggaaaggcucuccaccaagucuuuggagcaauuuauggggcugccuucaguggggucucauggacuaugaaaauccucauaggaguugucauuacauggauaggaaugaauucacgcagcaccucacugucugugucacuaguauuagugggagucgugacauuguauuugggaguuauggugcaggcugauagugguugcguugugaguuggaaaaacaaagaacugaaauguggcagugggauuuuuauuacagacaacguacacacauggacagaacaauacaaauuccaaccagaaucuccuucaaagcuggcuucagcuauccagaaagcucaugaagaaggcauuuguggaauccgcucaguaacaagacuggagaaucugauguggaaacaaauaacaccagaacugaaucacauucuaucagaaaaugagguaagguugacuaucaugacaggagacauuaaaggaaucaugcaggcaggaaaacgauccuugcggccucagcccacugagcugaaguauucauggaaaacuuggggcaaagcgaaaaugcucucuacagagcuucauaaccagaccuuucucauugauggccccgaaacggcagaaugucccaacacaaacagagcuuggaacucacuagaaguugaagacuauggcuuuggaguauucaccaccaacauauggcugaaauugaaagaaaggcaggauguauuuugugacucaaaacuuaugucagcggccauaaaagacaacagagccguccaugccgauauggguuauuggauagaaagcgcacuuaaugacacauggaagauagagaaagccucuuuuaucgaaguuaaaagcugccacuggccaaagucacauacucucuggaguaauggagugcuagaaagcgagaugauaauuccaaagaauuuugcuggaccagugucacaacacaacuacagaccaggcuaucacacacaaacggcaggacccuggcaucuagguaagcuugagauggacuucaauuucugcgaaggaacuacagugguggugacugaggacugugggaauagaggacccucuuuaagaacaacuaccgccucuggaaaacucauaacagaauggugcugccgaucuugcacauuaccaccgcuaagauacagaggugaggauggauguugguacgggauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagaccuggggagagugaugguuauggugggugccacuaugacggaugacauaggcaugggcgugacuuaucuugcccuacuagcagccuucaaaguuagaccaacuuuugcagcuggacuacucuugagaaagcugaccuccaaggaauugaugaugaccaccauaggaaucguacuccucucucagagcaccauaccagagacuauacuugaacugacugaugcguuggcucuggggaugaugguccucaaaauagugagaaauauggaaaaguaucaauuagcagugacuaucauggcuaucuugugcgucccaaaugcagugauacuacaaaacgcauggaaagugaguugcacaauacuggcagugguguccgucucuccacugcucuuaacauccucacagcagaaagcggauuggauaccauuggcauugacgaucaaaggccucaauccaacagccauuuucuuaacaacccuuucaagaacuagcaagaaaaggagcuggccacuaaaugaggcuaucauggcagucgggauggugagcauuuuagccaguucucucuuaaagaaugauauucccaugacaggaccacuaguggcuggagggcuucucacuguguguuacgugcucacuggaagaucggccgauuuggaacuggagagggccgccgacgugagaugggaagaucaggcagagauaucaggaagcaguccaauucugucaauaacaauaucggaagaugguagcaugucgauaaaaaaugaagaggaagaacaaacacugaccauacucauuagaacaggacugcuggugauaucaggacuuuuucccguaucaauaccaaucacggcagcagcaugguaccugugggaagugaagaaacaacgggcuggaguauugugggaugucccuucacccccacccgugggaaaggccgaacuggaagauggagcuuauagaaucaagcagaaagggauucuuggauacucccagaucggagccggaguuuacaaagaaggaacauuccacacgauguggcacguuacacguggugcuguucuaaugcauaaagggaagagaauugaaccaucaugggcggacgucaagaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggcgccgugucucuggacuuuucuccuggaacgucaggaucuccaaucgucgacaaaaaaggaaaaguugugggucuuuauggcaauggugucgucacaaggaguggaacauaugugagugccauagcccagacugaaaaaagcauugaagacaauccagagauugaagaugacaucuuucgaaagaaaagauugaccauuauggaccuccacccaggagcgggaaagacgaagagauaccuuccagcaauagucagagaggcuauaaaacgaggcuugagaacauuaauccuggcccccacuagagucguggcagcugaaauggaggaagcucuuagaggacuuccaauaagauaccaaaccccagccaucagagcugagcauacugggcgggagauuguggaucuaaugugccacgccacauuuaccaugaggcugcuaucaccaguuagagugccaaauuacaaccugaucaucauggaugaagcccacuucacagacccagcaagcauagcagcuagaggauacauuucaacucgaguagagaugggugaagcagcugggauuuucaugacagccacuccuccgggaagcagagacccauuuccucagagcaaugcaccaaucauggaugaagaaagggaaaucccugaacguucguggaauucuggacaugaguggguuacggacuuuaaagggaagacuguuugguuuguuccaaguauaaaagcaggaaaugauauagcagcuugccugagaaaaaauggaaagaaagugauacaacucaguagaaagaccuuugauucugaauauaucaagacuaggaccaaugauugggacuucguggucacgacugauauuucagaaaugggugccaacuucaaggcugagaggguuauagaccccagacgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagcuaagaugcuucuagauaacaucaacacgccugaaggaauuauucccagcauguucgaaccagagcgugaaaagguggaugccauugauggugaauaccgcuuaagaggagaagcgaggaaaaccuuuguggaccuaaugagaagaggagaccuaccagucuggcuggccuacagaguggcagcugaagguaucaacuacgcagacagaaggugguguuuugauggaaucaagaacaaccaaaucuuggaagaaaauguggaaguggaaauuuggacaaaagaaggggaaaggaagaaauuaaaacccagaugguuggaugcuaggaucuauucugacccgcuggcgcucaaagaauucaaggaauucgcagcuggaagaaagucccugacccugaaucuaaucacagagauggguaggcuuccaacuuucaugacucagaaagcaaggaacgcacuggacaacuuagcaguccugcacacggcugaagcaggcggaagggcguacaaucaugcucuuagugaacugccggagaccuuggagacauugcuucuacugacacuuuuggcuacagucacgggcggaaucuuucuauucuugaugagcggaaaggguauagggaaaaugacccugggaaugugcugcauaaucacggccaguauucuucuaugguacgcacaaauacaaccacacuggauagcagcuucaauaauacuggaguuuuuucucauagucuugcuuauuccagaaccagaaaagcagagaacaccccaagacaaccaauuaacuuacguugucauagccauccucacagugguggcugcaaccauggcaaacgagauggguuuccuggaaaaaacgaagaaagauuucggauugggaagcauugcaacccagcaacccgagagcaacauccuggacauagaucuacguccugcaucagcauggacucuguaugccguggccacaacauucaucacaccaauguugagacauagcauugaaaauuccucagugaaugugucccuaacagccauugccaaccaagccacaguguuaaugggucuugggaaaggauggccauugucaaaaauggacaucggaguuccccuucucgccauugggugcuauucacaagucaaccccauaacucucacagcagcccuucuuuuauuaguagcacauuaugcuaucauagggccaggacuccaagcgaaagcaaccagagaagcucagaaaagagcagcagcgggcaucaugaaaaacccaacuguagauggaauaacagugauugaccuagauccaauacccuaugacccaaaguuugaaaagcaguugggacaaguaaugcuccuaguccucugcgugacucaaguauugaugaugaggacuacaugggcuuugugugaggcucuaacccuagcgaccgggcccaucuccacauugugggaaggaaauccagggagauuuuggaauacaacuauugcagugucaauggcuaacauuuuuagagggaguuacuuggccggagcuggacuccucuuuucuaucaugaagaacacagccaacacaagaaggggaacuggcaacacaggagagacgcuuggagagaaauggaaaaaccgauugaaugcauuggggaagagugaauuccagaucuauaagaaaaguggaauccaggaaguggauagaaccuuagcaaaagaaggcauuaaaagaggagaaacggaccaucacgcugugucgcgaggcucagcaaaacugagaugguucgucgagagaaacuuggucacaccagaggggaaaguaguggaccucgguugcggcagagggggcuggucauacuauugugggggacuaaagaauguaagagaagucaaaggccuaacaaaaggaggaccaggacacgaagaacccauucccaugucaacauauggguggaaucuggugcgucuucaaaguggaguugauguuuuuuuuacuccgccagaaaagugugacacauugcugugugacauaggggagucgucaccaaaucccacgguugaagcaggacgaacacucagagucuuaaaccuaguggaaaauuggcugaacaacaacacccaauuuugcauaaagguucucaacccauacaugcccucagucauagaaaaaauggaagcgcuacaaaggaaauacggaggagcuuuggugaggaauccacucucacgaaauuccacacaugagauguacuggguuuccaaugcuuccgggaacauagugucaucagugaacaugauuucaaggauguugauuaacagauuuacaaugagacauaagaaggccacauacgagccagauguugaccucggaagcggaacccgcaacaucggaauugaaagugagacaccaaacuuagacauaauuggaaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuagacugcugacaaaaccuugggacgucaucccuauggugacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugaaacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagaugugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacgguaauggauauuauaucgagaagagaccaaagagguaguggacaaguuggcaccuauggucucaauacuuucaccaauauggaagcccaacuaaucagacagauggagggagaaggagucuucaaaagcauccagcaccugacagucacagaagaaauugcagugcaaaacuggcuagcaagaguggggcgugagagguuaucaagaauggccaucaguggagaugauuguguugugaaaccuuuagaugacagguuugcaagcgcucuaacagcucuaaaugacaugggaaagguuaggaaagacauacaacaaugggaaccuucaagaggauggaacgacuggacacaagugccuuuuuguucacaccacuuccaugaguuaaucaugaaagacggucguguacucguaguuccauguagaaaccaagaugaacugauugguagagcccgaauuucccagggagccggguggucuuugcgggagacggccuguuuggggaagucuuacgcccaaauguggagccugauguacuuccacagacgugaccucaggcuggcggcaaaugcuauuugcucggcagucccaucacauuggguuccaacaagucgaacaaccugguccauacacgccagacaugaauggaugacaacggaagacaugcugacagucuggaacaggguguggauucaagaaaacccauggauggaagacaaaacuccaguggaaucaugggaggaaaucccauaccuggggaaaagagaagaccaauggugcggcucauugauugggcuaacaagcagggccaccugggcaaagaacauccaaacagcaauaaaucaaguuagaucccuaauaggcaaugaggaauauacagacuacaugccauccaugaaaagauucagaagagaagaggaagaggcaggaguccugugguaa

SEQ ID NO: 7110 - RNA, 9876 nt, Artificial Sequence
  derived and/or modified CDS sequence (wt) from DENV-2__GQ398261__SS-prME
acugcaggcaugauuaucauguugauuccaacagugauggcguuccauuugaccacacgcaacggagaaccacacaugaucgucaguagacaagagaaagggaaaagucuucuguuuaaaacagaggauggugugaacauguguacccucauggccauggaucuuggugaauugugugaagacacaaucacuuauaauuguccucuucucaggcagaaugaaccagaagacauagacuguuggugcaacuccacguccacauggauaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuuggaucuugagacauccaggcuuuaccauaauggcagcaaucuuggcauacaccauaggaacgacauauuuucaaagaguccugauuuucaucuugcugacagcugucgcuccuucaaugacaaugcguuguauaggaauaucaaauagagacuuuguggaagggguuucaggaggaagcuggguugacauagucuuagagcauggaagcugugugacgacgauggcaaaaaauaaaccgacauuggauuuugaacugauaaaaacagaagccaaacaacccgcuacucuaaggaaguauuguauagaggcaaagcugaccaacacaacaacagcaucucgcugcccaacacaaggggaacccagccuaaaugaagagcaggacaaaagguucgucugcaaacauuccaugguagacagaggauggggaaauggaugcggauuauuuggaaagggaggcaucgugaccugugcuauguucacaugcaaaaagaacauggaaggaaaagucgugcaaccagaaaacuuggaauacaccauugugauaacaccucacucaggggaagagaaugcagucggaaaugacacaggaaaacacggcaaggaaaucaaaauaacaccacagaguuccaucacagaagcagaacugacaggcuauggcacugucacgauggagugcucuccgagaacgggccucgacuucaaugagaugguguugcugcaaauggaaaacaaagcuuggcuggugcacagacaaugguucuuagaccugccguuaccauggcugcccggagcggacacacaaggaucaaauuggauacaaaaggagacauuggucacuuucaaaaauccucaugcgaagaaacaggauguuguugucuuaggaucccaagaaggggcuaugcauacagcacuuacaggggccacggaaauccagaugucaucaggaaacuuacuguucacaggacaccucaagugcaggcugagaauggacaaacuacagcucaaaggaaugucauauucuauguguacaggaaaguuuaaaguugugaaggaaauagcagaaacacaacauggaacaauaguugucagaguacaauaugaaggggacgguucuccaugcaagaucccuuuugagauaauggauuuggaaaaaagacaugucuuaggucgcuugauuacagucaacccaauuguuacagaaaaagacagcccagucaacauagaagcagaaccuccauuuggagacagcuacaucauuauaggaguagaaccgggacaacugaagcucaacugguucaagaaaggaaguucuaucggccaaauguuugagacaacaaugagaggagcgaagagaauggccauuuuaggugacacagccugggauuucggaucccugggaggaguguucacaucuauaggaaaggcucuccaccaaguuuuuggagcaauuuauggggcugccuucaguggggucucauggacuaugaaaauccucauaggaguugucauuacauggauaggaaugaauucacgcagcaccucacugucugugucacuaguauuagugggagucgugacauuguauuugggaguuauggugcaggccgauagugguugcguugugaguuggaaaaacaaagaacugaaauguggcagugggauuuuugucacagacaacguacacacauggacagaacaauacaaauuccaaccagaaucuccuucaaagcuggcuucagcuauccagaaagcucaugaagaaggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgauccuugcggccucagcccacugagcugaaguauucauggaaaacuuggggcaaagcgaaaaugcucucuacagagcuucauaaccagaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcggccauaaaagacaacagagccguccaugccgauauggguuauuggauagaaagcgcacucaaugacacauggaagauagagaaagccucuuuuaucgaaguuaaaagcugccacuggccgaagucacauacucucuggaguaauggagugcuagaaagcgagaugauaauuccaaagaauuuugcuggaccagugucacaacacaacuacagaccaggcuaucacacacaaacggcaggacccuggcaucuagguaagcuugagauggacuuuaauuucugcgaaggaacuacagugguggugaccggggacugugggaauagaggacccgcuuuaagaacaacuaccgccucuggaaaacucauaacagaauggugcugccgaucuugcacauuaccaccgcuaagauacagaggugaggauggauguugguacgggauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuuugugacauugaucacagggaacauguccuuucgagaccuggggagagugaugguuauggugggugccacuaugacggaugacauaggcaugggcgugacuuaucuugcccuacuagcagccuucaaaguuagaccaacuuuugcagcuggacuacucuugagaaagcugaccuccaaggaauugaugaugaccaccauaggaaucguacuccucucucagagcaccauaccagagacuauacuugaacugacugaugcguuggcucuggggaugaugguccucaaaauagugagaaauauggaaaaguaucaauuagcagugacuaucauggcuaucuugugcgucccaaaugcagugauauuacaaaacgcauggaaagugaguugcacaauacuggcagugguguccgucucuccacugcucuuaacauccucacagcagaaagcggauuggauaccauuggcauugacgaucaaaggccucaauccaacagccauuuucuuaacaacccuuucaagaacuagcaagaaaaggagcuggccacuaaaugaggcuaucauggcagucgggauggugagcauuuuagccaguucucucuuaaagaaugauauccccaugacaggaccacuaguggcuggagggcuccucaccguguguuacgugcucacuggaagaucggccgauuuggaacuggagagggccgccgacgugagaugggaagaucaggcagagauaucaggaagcaguccaauucugucaauaacaauaucggaagaugguagcaugucgauaaaaaaugaagaggaagaacaaacacugaccauacucauuagaacaggacugcuggugauaucaggacuuuuucccguaucaauaccaaucacggcagcagcaugguaccugugggaagugaagaaacaacgggcuggaguauugugggaugucccuucacccccacccgugggaaaggccgaacuggaagauggagcuuauagaaucaagcagaaagggauucuuggauacucccagaucggagccggaguuuacaaagaaggaacauuccacacgauguggcacguuacacguggugcuguucuaaugcauaaagggaagagaauugaaccaucaugggcggacgucaagaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggcgccgugucucuggacuuuucuccuggaacgucaggaucuccaaucgucgacaaaaaaggaaaagucgugggccuuuauggcaauggugucgucacaaggaguggaacauaugugagugccauagcccagacugaaaaaagcauugaagacaauccagagauugaagaugacaucuuucgaaagaaaagauugaccauuauggaccuccacccaggagcgggaaagacgaagagauaccuuccagcaauagucagagaggcuauaaaacgaggcuugagaacauuaauccuggcccccacuagagucguggcagcugaaauggaggaagcucuuagaggacuuccaauaagauaccaaaccccagccaucagagcugagcacacugggcgggagauuguggaucuaaugugccacgccacuuuuaccaugaggcugcuaucaccaguuagagugccaaauuacaaccugaucaucauggaugaagcccauuucacagacccagcaagcauagcagcuagaggauacauuucaacucgaguagagaugggugaagcagcugggauuuucaugacagccacuccuccgggaagcagagacccauuuccucagagcaaugcaccaaucauggaugaagaaagggaaaucccugaacguucguggaauucuggacaugaguggguuacggacuuuaaagggaagacuguuugguuuguuccaaguauaaaagcaggaaaugauauagcagcuugccugagaaaaaauggaaagaaagugauacaacucaguagaaagaccuuugauucugaauauaucaagacuaggaccaaugauugggacuucguggucacgacugacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugugcacauuggaaagaagcuaagaugcuucuagauaacaucaacacgccugaaggaaucauucccagcauguucgaaccagagcgugaaaagguggaugccauugauggugaauaccgcuuaagaggagaagcgaggaaaaccuuuguggaccuaaugagaagaggagaccuaccagucuggcuggccuacagaguggcagcugaagguaucaacuacgcagacagaaggugguguuuugauggaaucaagaacaaccaaaucuuggaagaaaauguggaaguggaaauuuggacaaaagaaggggaaaggaagaaauuaaaacccagaugguuggaugcuaggaucuauucugacccgcuggcgcucaaagaauucaaggaauucgcagcuggaagaaagucccugacccugaaucuaaucacagagauagguaggcuuccaacuuucaugacucagaaagcaaggaacgcacuggacaacuuagcaguccugcauacggcugaagcaggcggaagggcauacaaucaugcucuuagugaauugccggagacccuggagacauugcuuuuacugacacuuuuggcuacagucacgggcggaaucuuucuauucuugaugagcggaaaggguauagggaaaaugacccugggaaugugcugcauaaucacggccaguauucuccuaugguacgcacaaauacaaccacacuggauagcagcuucaauaauacuggaguuuuuucucauagucuugcuuauuccagaaccagaaaagcagagaacaccccaagacaaccaauuaacuuacguugucauagccauccucacagugguagcugcaaccauggcaaacgagauggguuuccuggaaaaaacgaagaaagauuucggauugggaagcauugcaacccagcaacccgagagcaacauccuggacauagaucuacguccugcaucagcauggacucuguaugccguggccacaacauucaucacaccaauguugagacauagcauugaaaauucuucagugaauguuucccuaacagcuauugccaaccaagccacaguguuaaugggucuugggaaaggauggccauugucaaaaauggacaucggaguuccccuucucgccaucgggugcuauucacaagucaaccccauaacucucacagcagcccuucuuuuauugguagcacauuaugcuaucauagggccaggacuccaagcgaaagcaaccagagaagcucagaaaagagcagcagcgggcaucaugaaaaacccaacuguagauggaauaacagugauugaccuagauccaauacccuaugauccaaaguuugagaagcaguugggacaaguaaugcuccuaguccucugcgugacucaaguauugaugaugaggacuacaugggcuuugugugaggcucuaacccuagcgaccgggcccaucuccacauugugggaaggaaauccagggagauuuuggaauacaacuauugcagugucaauggcuaacauuuuuagagggaguuacuuggccggagcuggacuccucuuuucuaucaugaagaauacagccaacacaagaaggggaacuggcaacacaggagagacgcuuggagagaaauggaaaaaccgauugaaugcauuggggaagagugaauuccagaucuauaagaaaaguggaauucaggaaguggauagaaccuuagcaaaagaaggcauuaaaagaggagaaacggaccaucacgcugugucgcgaggcucagcaaaacugagaugguucgucgagagaaaccuggucacaccagaggggaaaguaguggaccucgguugcggcagagggggcuggucauacuauugugggggacuaaagaauguaagagaagucaaaggccuaacaaaaggaggaccaggacacgaagaacccauucccaugucaacauauggguggaaucuggugcgucuucaaaguggaguugauguuuuuuuuacuccgccagaaaagugugacacauugcugugugacauaggggagucgucaccaaaucccacgauugaagcaggacgaacacucagagucuuaaacuuaguggaaaauuggcugaacaacaacacccaauuuuguauaaagguucucaacccauacaugcccucagucauagaaaaaauggaagcgcuacaaaggaaauacggaggagcuuuggugaggaauccacucucacgaaauuccacacaugagauguacuggguuuccaaugcuuccgggaacauagugucaucagugaacaugauuucaaggauguugauuaacagauuuacaaugagacauaagaaggccacauacgagccagauguugaccucggaagcggaacccgcaacaucggaauugaaagugagacaccaaacuuagacauaauuggaaaaagaauagaaaaaauaaaacaagagcaugaaacaucauggcacuaugaccaagaccacccauacaaaacgugggccuaccauggcagcuacgaaacaaaacagaccggaucagcaucauccauggugaacggaguagucagauugcugacaaaaccuugggacgucaucccuacgguaacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugaaacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagaugugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacgguaauggauauuauaucgagaagagaccaaagagguaguggacaaguuggcaccuauggucucaauacuuucaccaauauggaagcccaacuaaucagacagauggagggagaaggagucuucaaaagcauccagcaccugacagucacagaagaaauugcagugcaaaacuggcuagcaagaguggggcgugagagguuaucaagaauggccaucaguggagaugauuguguugugaaaccuuuagaugacagguuugcaagcgcucuaacagcucuaaaugacaugggaaagguuaggaaagacauacaacaaugggaaccuucaagaggauggaacgacuggacacaagugccuuuuuguucacaccacuuccaugaguuaaucaugaaagacggucguguacucguaguuccauguagaaaccaagaugaacugauugguagagcccgaauuucacagggagccggguggucuuugcgggagacggccuguuuggggaagucuuacgcccaaauguggagccugauguacuuccacagacgugaccucaggcuggcggcaaaugcuauuugcucggcagucccaucacauuggguuccaacaagucgaacaaccugguccauacacgccagacaugaauggaugacaacggaagacaugcugacagucuggaacaggguguggauucaagaaaacccauggauggaagacaaaacuccaguggaaucaugggaggaaaucccauaccuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7111 - RNA, 9876 nt, Artificial Sequence
  derived and/or modified CDS sequence (wt) from DENV-2__GQ398313__SS-prME
acagcaggcgugauuauuauguugauuccaacagcgauggcauuccauuuaaccacacguaauggagaaccacacaugaucguugguaggcaagagaaagggaaaagucuucuguucaaaacagaggacgguguuaacauguguacccucauggccauagaccuuggugaauugugugaagauacaauuacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccaguuaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgccaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcuuuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgaugugaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucaauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggcagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaaccuagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcguaacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagauauaauaggaaagagaauagagaaaauaaagcaagagcaugaaacaucauggcacuaugaccaagaccacccauacaaaacgugggcuuaccauggcagcuacgaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggaugugcaccagagaagaauuuacaagaaaggugagaagcaacgcagccuugggggccauauucacugaugagaacaaauggaaaucggcacgugaggcuguugaagauagcagguuuugggagcugauugacagggaaagaaaucuccaucuugaaggaaagugugaaacaugcguguacaacaugaugggaaaaagagagaagaaacuaggggaguucggcaaggcaaaggguagcagagccauaugguacauguggcuuggagcacgcuuccuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagacgaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7112 - RNA, 9876 nt, Artificial Sequence
  derived and/or modified CDS sequence (wt) from DENV-2__GQ398285__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcacucguuccacauguggguaugggacuagagacacgaacugaaacauggaugucaucagaaggggccuggaaacauguucagagaauugaaaccuggauccugagacauccaggcuuuaccauaauggcagcaauccuggcauacaccauaggaacaacacauuuccaaagggccuugauuuucauccuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaaugggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggacgucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaacccccauucggagacagcuacauuaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggaacaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuggcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggaggcauuaaaggaaucaugcaggcaggaaaacgaucuuugaggccccagcccacugagcugaaguacucauggaaaacauggggaaaggcgaaaaugcucuccacagaaucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagcgagaugauaauuccaaaaaauuuagccgggccagugucacaacacaauuacagaccaggcuaccacacacaaacagcaggaccuuggcaucuagguaagcuugagauggacuuugauuucugugaaggaaccacagugguggugacugaggacuguggaaauagaggacccucuuuaagaacgaccacugccucuggaaaacucguaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagagcaaacacugacuauacucaucagaacgggauuguuggugaucucaggagucuuuccaguaucaauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccagguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauacgugagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauuaauccuggcucccacuagagucguggcagcugaaauggaggaagcucuuagaggacuuccaauaagauaccaaaccccagccauuagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcgccaaucauggaugaggaaagagaaaucccugagcguucguggaauucaggacaugaaugggucacggauuuuaaagggaagacuguaugguucguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggacccaugccagugacccacucuagugcagcgcaaagaagagggagaauaggaagaaauccaaaaaaugaaaaugaccaguacauauauaugggggaaccccuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaacuuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaacuaaaacccagaugguuggaugcuaggaucuauucugacccacuggcacuaaaagaauucaaggaauuugcagcuggaagaaaauccuugacccugaaccuaaucacagaaauggguaggcuuccaacuuucaugacucagaaggcaagaaacgcacuggacaauuuagcugugcugcauacggcugaggcagguggaagggcguacaaucaugcucucagugaacugccggagacccuggagacacugcuuuuacugacacuccuggccacagucacaggaggaaucuuuuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucucuaacagcuauugcuaaccaagccacagugcuaaugggucuugggaaaggauggccauugucaaagauggacaucggaguuccccuccuugccauuggaugcuacucacaagucaacccuauaacccucacagcagcccuucuuuuauuaguagcacauuaugccauuauagggccaggacuucaagcaaaagcaaccagagaagcucagaaaagagcagcagcaggcaucaugaaaaacccaacgguugauggaauaacagugauugaccuagaaccaauacccuacgauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaacccacucucacgaaacuccacacaugagauguacuggguauccaaugcuaccgggaacauagugucaucagugaauaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaucacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggauacgagaacucaagaaccgaaggaaggcacaaagaaacugaugaaaauuacggcagaguggcuuuggaaagaacuaggaaaggaaaagacacccaggauguguaccagagaagaauuugcaagaaaggugagaagcaaugcagccuugggggccauauucacugaugagaacaaauggaaaucggcacgcgaggcuguugaagauaguagguuuugggagcugauugacagggaaagaaaucuccaucuugaaggaaagugugaaacauguguguacaacaugaugggaaaaagagagaagaaacuaggggaguucgguaaggcaaaagguagcagagccauaugguacauguggcuuggagcacgcuucuuagaguuugaagcccuaggauucuugaaugaagaucacugguucuccagagagaacucccugaguggaguggaaggagaggggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagcagaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagccacagaagaaaucgcuguacagaacugguuagcaagaguggggcgugaaaggcuaucaagaauggccaucaguggagaugauuguguuguaaaaccuuuggaugacagauuugcaagugcuuuaacagcccuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaaaucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaauccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccggugucuugugguag

SEQ ID NO: 7113 - RNA, 9876 nt, Artificial Sequence
  derived and/or modified CDS sequence (wt) from DENV-2__GQ398298__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucauauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggacucuugggaauggcacuguuccuggaagaaaugcucaggacccgaguaggaacgaagcaugcaaugcugcuaguuguaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcacuauaccagagaccauucuugaauugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucaauaccaaucacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacaucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaggaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacacagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggauacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuuccuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7114 - RNA, 9876 nt, Artificial Sequence
  derived and/or modified CDS sequence (wt) from DENV-2__GQ398301__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggugaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcagcauccuuugugacauugauuacugggaacauguccuuuagagaccugggaagagugaugguuauggugggcgcuaccaugacggaugacauagguaugggaauaacuuaucuugcucuacuagcagcuuucaaagucaggccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggacuuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaucaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacguauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugaaaaucacggcagaguggcucuggaaagaacuaggaaaggaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaacgaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7115 - RNA, 9876 nt, Artificial Sequence
  derived and/or modified CDS sequence (wt) from DENV-2__GQ398312__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucagaaggggccuggaaacauguucagagaaucgaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuggaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaaacuugagauggacuuugauuucugcgaaggaaccacagugguggugacugaggacuguggaaauagaggacccucuuuaagaacgaccacugccucuggaaaacucauaacagaauggugcugucgauccuguacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccugggaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauucccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguagcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcugaugggucuugggaaaggauggccauugucaaagauggacaucggaguuccccuccuugccauuggaugcuacucacaagucaacccuauaacucucauagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcagaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuacgaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7116 - RNA, 9876 nt, Artificial Sequence
  derived and/or modified CDS sequence (wt) from DENV-2__GQ398289__SS-prME
acagcaggcgugauuauuauguugauuccaacagcaauggcguuccauuuaaccacacguaauggagaaccacacaugaucguugguaggcaagagaaagggaaaagucuucuguucaaaacagaagaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucgucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacccaacauggaacaauaguuaucagaguacaauaugaaggggauggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguuguguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaacugaaucacauucuaucagaaaaugagguaaaguugaccauuaugacaggagacacuaaaggaaucaugcaggcaggaaaacgaucuuugaggccccagcccacugagcugaaguacucauggaaaacauggggaaaggcaaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgagugggaacgaaacaugcaauacugcuaauugcaguaucuuuugugacauugauuacugggaacauguccuuuagagaccugggaagagugaugguuauggugggcgcuaccaugacggaugacauagguaugggagugacuuaucuugcccuacuagcagcuuucaaagucagaccaacuuuugcagcuggacuacucuugagaaaacugacuuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggccaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauugcuggugaucucaggagucuuuccaguaucaauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccugggaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucucuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacacagggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagccaaaaugcuucuagauaacaucaacacaccugaaggaaucauuccuagucuguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaacuuaaucacagaaauggguaggcuuccaacuuucaugacucagaaggcaagagacgcacuggacaacuuagcugugcugcauacggcugaggcagguggaagggcauacaaucaugcucucagugaacugccggagacccuggagacacugcuuuuacugacacuccuggccacagucacaggaggaaucuucuuauucuuaaugagcggaagagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauucuucagugaaugucucccuaacagcuauugcuaaccaagccacagugcugaugggucuugggaaaggauggccauugucaaagauggacaucggaguuccccuccuugccauuggaugcuacucacaagucaacccuauaacccucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaaccaauccccaugucaacauauggguggaaucuagugcgucugcaaaguggaguugacguuuucuucaccccgccagaaaagugugauacauuguugugugacauaggggagucgucaccaaaucccacgauagaagcaggacggacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguaucuaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauagggaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagaaggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacaguuacagaagaaaucgcuguacagaacugguuagcaagagugggacgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucaggcuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7117 - RNA, 9876 nt, Artificial Sequence
  derived and/or modified CDS sequence (wt) from DENV-2__GQ398290__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagagaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuguuuggaaagggaggcauugugaccugugcuauguuuacaugcaaaaagaacauggaaggaaaagucgugcugccagaaaauuuugaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagaugguguugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucgggaaacuuacuguucacaggacaucucaagugcaggcugagaauggacaaacuacagcucaaaggaaugucauacucuauguguacaggaaaguuuaaaauugugaaggaaauagcagaaacccaacauggaacaauaguuaucagaguacaauaugaaggggauggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguuguguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugaucucugcgaaggaaccacagugguggugacugagaacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugacuuccaaggaauuaaugauggccaccauaggaauugcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacguuccuucacccccgccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagcuauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugacugggacuuuguggucacaaccgacauuucagaaaugggugccaacuucaaggcugagaggguuauagaccccagacguugcaugaaaccaguaauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcauacaaucaugcucucagugaacugccggagacccuggagacacugcuuuuacugacacuccuggccacagucacaggaggaaucuucuuauucuuaaugagcggaagaggcauaggaaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggccacaacauucgucacaccaauguugagacauagcauugaaaauucuucagugaaugucucccuaacagcuauugcuaaccaagccacagugcugaugggucuugggaaaggauggccauugucaaagauggacaucggaguuccccuccuugccauuggaugcuacucacaagucaacccuauaacccucacagcagcccuucuuuuauugguagcacauuaugccauuauagggccaggacuucaagcaaaagcaaccagagaagcucagaaaagagcagcagcaggcaucaugaaaaacccaacagucgauggaauaacaguaauugaccuagaaccaauacccuaugauccaaaauuugaaaagcaguuaggacaaguaaugcuccuaauucucugcgugacucaaguauuaaugaugaggaccacaugggcucugugugaggcccuaacucuagcgaccgggcccaucuccacacugugggaaggaaauccagggagguuuuggaacacuaccauugcagugucaauggcuaauaucuuuagggggagcuacuuggccggagcuggacuccucuuuuccaucaugaagaacacaacaaacacaagaagaggaacuggcaacauaggagagacacucggagaaaaauggaagagccgauuaaacacacuggggaaaagugaauuucagaucuacaagaaaaguggaauccaggaaguggauagaaccuuagcaaaagaagguaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauacaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugaucaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauucggacaacaacgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcgggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagccacagaagaaaucgcuguacagaacugguuagcaagaguggggcgugaaaggcuaucaagaauggccaucaguggagaugauuguguuguaaaaccuuuggaugacagauuugcaagugccuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucaggcuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauaccuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7118 - RNA, 9876 nt, Artificial Sequence
  derived and/or modified CDS sequence (wt) from DENV-2__GQ398284__SS-prME
acagcaggcgugauuauuauguugauuccaacagcgauggcguuccaucuaaccacacguaacggagaaccacacaugaucguugguaagcaagagaaagggaaaagucuucuguucaaaacagaggaugguguuaacaugugcacccucauggccauagaccuuggugaauugugugaagauacaaucacguacaaguguccccuccucagacaaaaugaaccagaagacauagacuguuggugcaacuccacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugaucuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacacuggauuuugaacugauaaaaacagaagccaaacaaccugccacucuaaggaaguacuguauagaagcaaaacugaccaacacaacaacagaaucucguugcccaacacaaggggaacccagucugaaugaagagcaggacaaaagguuccucugcaaacacuccaugguagauagaggauggggaaauggauguggauuauuuggaaagggaggcauugugaccugugcuauguuuacaugcaagaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagaugguguugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugcuuuaggaucucaagaaggggccaugcacacggcacucacaggggccacagaaauccagaugucaucaggaaaccuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggauggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauagggcugcuuuuaguggggucucauggacuaugaaaauccucauaggagucaucaucacauggauaggaaugaauucacguagcaccucacugucugugucacugguauuggugggagucgugacacuguaccugggagcuauggugcaggcugauagugguugcguugugagcuggaaaaauaaagaacugaaauguggcagcgggaucuuuaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagauuaugguuuuggaguuuuuaccaccaauauauggcuaaaauugagagaaaaacaggauguauuuugugacucaaaacucaugucagccgccauaaaagacaacagagccguccaugccgauauggguuauuggauagaaagugcacucaaugacacauggaagauggagaaagccucuuucauugaaguuaaaagcugucacuggccaaagucacacacccucuggagcaauggaguauuagaaagcgagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgagugggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauagggaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuuccccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugacauucccaugacagguccauuaguggcuggagggcuccuuacuguguguuacgugcucacuggacgaucggccgauuuggaacuggagagagcugccgacgugaaaugggaagaucaggcagaaauaucaggaagcagcccaauccugucaauaacaauaucagaagauggcagcaugucaaucaaaaaugaagaggaagaacaaacacugaccauacucaucagaacgggauuguuggugaucucaggagucuuuccgguaucaauaccaaucacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccagguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccauuagagccgagcacacugggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggagccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacauuaacacaccugaaggaaucauuccuaguauguucgaaccagagcgugaaaagguggaugccauugauggugaauaccguuuaagaggagaagcaaggaaaaccuuuguggaccuaaugagaagaggggacuuaccagucuggcuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuagaaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagccguacugcacacggcugaggcagguggaaaggcauacaaucaugcucucagugaacugccggagacccuggagacacugcuuuugcugacacuccuggccacagucacaggaggaaucuucuuauucuuaaugagcggaaaagguauagggaagaugacccugggaauguguugcauaaucacggcuaguauccuccuaugguaugcacaaauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccuaggauugggaagcauuauaacccaggaauccgagagcaacauccuggacauagaucuacguccugcaucagcauggacgcuguaugccguggcuacaacauuugucacaccaauguugagacauagcauugaaaauuccucaguuaaugucucccuaacagccauugcuaaccaagccacagugcuaaugggucuugggaaaggauggccauugucaaagauggacaucggaguuccccuccuugccauuggaugcuacucacaagucaaccccauaacucucacagcagcucuucuuuuguugguagcacauuaugccauuauagggccaggacuucaagcaaaagcaaccagagaagcucagaaaagagcagcagcaggcaucaugaaaaacccaacaguugauggaauaacagugauugaccuagaaccaauacccuaugauccaaaauuugaaaagcaguuaggacaaguaaugcuccuaauccucugcgugacucaaguauuaaugaugaggacuacaugggcucugugugaggcuuuaacuuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaaaaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugcgggggauuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucgcgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauucacaagaaaggugagaagcaaugcagccuugggggccauauucacugaugagaacaaauggaagucggcacgugaggcuguugaggauaguagguuuugggagcugguugacagggaaagaaaucuccaucuugaaggaaagugugaaacauguguguacaacaugaugggcaaaagagagaagaaacuaggggaguucggaaaggcaaaagguagcagagccauaugguacauguggcuuggagcacgcuucuuagaguuugaagcccuaggauucuugaaugaagaucauugguucuccagagggaacucccugaguggaguggaaggagaaggguugcacaggcuaggcuacauuuuaagagacgugagcaagaaggaagggggagcaauguaugccgaugauacagcaggaugggacacaagaaucacacuagaagaccuaaaaaaugaagaaaugguaacaaaccacaugaaaggagaacacaagaaacuagccgaggccauauucaaauuaacguaccaaaacaagguggugcgugugcaaagaccaacgccaagaggcacaguaauggauaucauaucgagaagagaccaaagaggcagugggcaagucggcaccuauggccuuaauacuuucaccaacauggaagcccaauuaauuagacagauggaaggagaaggaaucuucaaaagcauucagcaccugacaguuacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacgacuugguccauacacgcuaaccaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcaggugucuugugguag

SEQ ID NO: 7119 - RNA, 9876 nt, Artificial Sequence
  derived and/or modified CDS sequence (wt) from DENV-2__GQ398308__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcuuugauuuucaucuuacugacggcugucgcuccuucaaugacaaugcguugcauaggaauaucaaauagagacuucguagaagggguuucaggaggaagcuggguugacauagucuuggaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacauuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaagcgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggcuauaaaagacaacagagccguccaugccgacauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaaacuugagauggacuuugauuucugcgaaggaaccacagugguggugacugaggacuguggaaauagaggacccucuuuaagaacgaccacugccucuggaaaacucauaacagaauggugcugucgauccuguacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagccaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaaucacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagaaaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggaugaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcucggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuagccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaaugacacccaauuuugcauaaagguucucaacccauauaugcccucagucauagaaaaaauggaaacacuacaaaggaaauauggaggagccauagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuacgaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaaguauucagcaccugacagucacagaagaaaucgcuguacagaacugguuagcaagaguggggcgugaaaggcuaucaagaauggcuaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcugacagucuggaauaggguguggauccaggaaaacccguggauggaagacaaaacuccuguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7120 - RNA, 9876 nt, Artificial Sequence
  derived and/or modified CDS sequence (wt) from DENV-2__GQ398287__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucgucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuugggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacccaacauggaacaauaguuaucagaguacaauaugaaggggauggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguuguguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcaaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccuuuggagcaauggaguauuggaaagugagaugauaauuccaaaaaaucuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgagugggaacgaaacaugcaauacugcuaauugcaguaucuuuugugacauugauuacugggaacauguccuuuagagaccugggaagagugaugguuauggugggcgcuaccaugacggaugacauagguaugggagugacuuaucuugcccuacuagcagcuuucaaagucagaccaacuuuugcagcuggacuacucuugagaaaacugacuuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggccaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauugcuggugaucucaggagucuuuccaguaucgauaccaauuacggcagcagcaugguaccugugggaagugaagaaacaacgggcuggaguauugugggacgucccuucacccccaccaguggaaaaagccgaacuggaagauggagccuauagaaucaagcaaagagggauucuuggauacucucagauuggagcuggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccugggaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucucuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacacagggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagccaaaaugcuucuagacaacaucaacacaccugaaggaaucauuccuagucuguucgaaccagagcgugaaaaaguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcauacaaucaugcucucagugaacugccggagacccuggagacacugcuuuuacugacacuccuagccacagucacaggaggaaucuucuuauucuuaaugagcggaagagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauucuucagugaaugucucccuaacagcuauugcuaaccaagccacagugcugaugggucuugggaaaggauggccauugucaaagauggacaucggaguuccccuccuugccauuggaugcuacucacaagucaacccuauaacccucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguguucuucaccccgccagaaaagugugauacaguguugugugacauaggggagucgucaccaaaucccacgauagaagcaggacggacgcuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguaucuaaugcuaccgggaacauagugucaucagugaacaugauuucaaggauguugauuaacagauucacaaugaagcacaagaaagccaccuacgagccagauguugaccuaggaagcggaacccgcaacauuggaauugaaagugagauaccaaaccuagacauaauagggaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacugggggaguucggcaaggcaaaagguagcagagccauaugguacauguggcuuggagcacgcuucuuagaguuugaagcccuaggauucuugaaugaagaucacugguucuccagaaggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacaguuacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugauaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucaggcuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7121 - RNA, 9876 nt, Artificial Sequence
  derived and/or modified CDS sequence (wt) from DENV-2__GQ398302__SS-prME
acagcaggcgugauuauuauguugauuccaacagcgauggcguuccauuuaaccacacguaauggagaaccacacaugaucguuaguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguucacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugcgacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaagaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauugaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuauuauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuucuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucguauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaucguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaucaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauagucuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacguauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaacgaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugauagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccuuggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7122 - RNA, 9876 nt, Artificial Sequence
  derived and/or modified CDS sequence (wt) from DENV-2__GQ398272__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggacggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagggggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucauagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugaucaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccucaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 7123 - RNA, 9876 nt, Artificial Sequence
  derived and/or modified CDS sequence (wt) from DENV-2__GQ398292__SS-prME
acagcaggcguguuuauuauguugauuccaacagcaauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucaugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagauucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaaugcggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggagaaguaccaauuggcagugacuaucauggcuaucucgugugucccaaaugcagugauauugcaaaacgcauggaaggugaguugcacaauauuggcagcgguguccguuucuccacugcucuugacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucagggagcagcccaauccugucaauaacaauaucagaggauggcagcaugucgauaaaaaaugaagaggaagaacaaacacugacuauacucaucagaacgggauuguuggugaucucaggagucuuuccaguaucgauaccaaucacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcaugucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuagaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauucacuaugaggcugcuaucaccagucagagugccaaauuacaaccugaucaucauggacgaagcccacuucacagacccagcaaguauagcggcuagaggauacauuucaacucgaguagagaugggugaagcagcugggauuuucaugacagccacuccuccgggaaguagagacccauuuccucagagcaaugcaccaaucauggaugaggaaagagaaauccccgagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaaggaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaucucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacggcuauugcuaaccaagccacagugcuaaugggucuugggaaaggauggccauugucaaagauggacaucggaguuccccuccuugccauuggaugcuacucacaagucaacccuauaacucucacagcagcccuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugaucucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 7124 - RNA, 9876 nt, Artificial Sequence
  derived and/or modified CDS sequence (wt) from DENV-2__GQ398267__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcuuaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggccgccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauauuaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucauugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacauaggagagacgcuuggagagaaauggaaaaaccgguugaaugcauuagggaagagugaauuccagaucuacaagaaaaguggaauccaggaaguggauagaaccuuagcaaaagaaggcaucaaaagaggagagacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccaccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuacgaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaauagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacacgaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7125 - RNA, 9876 nt, Artificial Sequence
  derived and/or modified CDS sequence (wt) from DENV-2__GQ398266__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagccugggauuuuggaucucugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguacuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuaacaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucauugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7126 - RNA, 9876 nt, Artificial Sequence
  derived and/or modified CDS sequence (wt) from DENV-2__GQ398265__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagccugggauuuuggaucucugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguacuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuaacaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7127 - RNA, 9876 nt, Artificial Sequence
  derived and/or modified CDS sequence (wt) from DENV-2__KX702403__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuugaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacauguaaaaagaacauggaaggaaaaaucguacagccagaaaauuuggaauacaccaucgugauaacaccucacucaggagaagagcacgcuguaggcaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaaguugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacugugaaaaaagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugacgcguuagccuuggguaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagaucggagccggaguuuacaaagaaggaacauuccauacaauguggcacgucacacguggugcuguucugaugcauagagggaagaggauugaaccaucaugggcagacgucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacagaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugagaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaauugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuauucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauaccccaugauccaaaauuugaaaagcaguuaggacaaguaaugcuccuaauccucugcgugacucaaguauuaaugaugaggacuacaugggcuuugugugaggcucuaacccuggcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccguaacauuggaauugaaagugagacaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccaauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugauagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaccgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaucaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauucaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccaucaaugaagagauucagaagggaagaggaagaggcagguguccugugguag

SEQ ID NO: 7128 - RNA, 9876 nt, Artificial Sequence
  derived and/or modified CDS sequence (wt) from DENV-2__KX702404__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcacguucagagaauugaaaccuggaucuugagacauccagguuuuaccauaauggcagcgauccuggcauacaccauaggaacgacacacuuccaaagggccuugauuuucauuuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacacuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuagucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaagucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccuaggaggaguguuuacaucuauaggaaaggcucuucaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagauaaaguugaccauuaugacaggagauauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccucuuucauugaaguuaaaagcugccacuggccaaagucacacacccuauggagcaauggaguauuagaaagugagaugauaauuccaaaaaacuuugccgggccagugucacaacacaacuacagaccaggcuaccauacacaaacagcaggaccuuggcaucuagguaagcuugagauggacuuugauuucugcgaaggaacuacagugguggugaccgaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucauuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagccaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacagacacugaccauacucauuagaacgggauuguuggugaucucaggagucuuuccaguaucgauaccaauuacggcagcagcaugguaccugugggaagugaagaaacaacgggcuggaguauugugggacguuccuucacccccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcacagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggacccaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcauuaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaauugccggagacucuggagacacugcuucuacugacacuccuggcagcaguuacaggaggaaucuucuuauucuuaaugagcggaaaagguauagggaagaugacucugggaauguguugcauaaucacagcuagcauucuccuaugguacgcacagauacaaccacacuggauagcagcuucaauaauacuggaguuuuuucucauaguuuugcucauuccagaaccagaaaaacagagaacaccccaagacaaccaauugaccuacguugucauagccauccucacagugguggcugcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacgugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggagagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucaccaaugaaaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcuaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaaguugguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucagcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagagaagaggaagaggcagguguccugugguag

SEQ ID NO: 7129 - RNA, 9873 nt, Artificial Sequence
  derived and/or modified CDS sequence (wt) from DENV-2__JQ686088__SS-prME
accacaggcaugaucaucaugcugauuccaacagugauggcguuccauuuaaccacacgcaacggagaaccacacaugauugucagcagacaggauaaagggaaaagccuucuguuuaagacaaaggauggcacgaacauguguacccucauggccauggaccuuggugaauugugugaagacacaaucacguauaaaugucccuuucucaagcagaacgaaccagaagacauagauuguuggugcaacuccacguccacauggguaacuuaugggacgugcaccaccacaggagagcacagaagagaaaaaagaucaguagcgcucguuccacaugugggaaugggauuggagacacgaacugaaacauggaugucaucagaaggagccuggaaacaugcccagagaauugaaacuuggauccugagacauccaggcuuuaccauaauggcagcaauccuggcauacaccauaggaacgacacauuuccaaagaguccugauuuucauccuacugacagcugucgcuccuucaaugacaaugcgcuguauaggaauagcaaauagggacuucguggaagggguuucaggaggaagcuggguugacauagucuuagaacacggaagcugugugacgacgauggcaaaaaacaaaccaacacuggacuuugaacugauaaaaacagaagccaaacaacccgccacucuaaggaaguacugcauagaggcuaagcugaccaacacgacaacagauucgcgcugcccaacacaaggggaaccuagccugaaugaagagcaggacaaaagguuugucugcaaacauucuaugguagacagaggauggggaaauggaugcggauuguuuggaaaaggaggcaucgugaccugugcuauguucacaugcaaaaagaauaugaaaggaaaaauugugcagccagaaaacuuggaauacaccaucgugauaacaccucacucaggggaagaacaugcagucggaaaugacacaggaaaacauggcaaggaagucaaaauaacaccacagagcuccaucacagaagcggaacugacaggcuauggcacuguuacgauggagugcucuccgagaacgggccucgacuucaaugagaugguguugcugcaaauggaagauaaagcuuggcuggugcacagacaaugguuccuagaccugccguuaccauggcugcccggagcagauacacaaggaucaaauuggauacagaaagagacauuggucacuuucaaaaauccccaugcaaaaaaacaggauguuguugucuuaggaucccaagagggggccaugcacacagcacucacaggggcuacggaaauccagaugucaucaggaaaccuacuguucacaggucaucuuaagugcaggcugagaauggacaaacuacagcuuaaagggaugucauacucuauguguacagggaaguuuaaagucgugaaggaaauagcagaaacacaacauggaacaauagucauuagaguacaauaugaaggagacggcuccccaugcaagaucccuuuugagauaauggaucuggaaaaaagacaugucuuaggucgucugauuacagucaacccaauuguaacagaaaaggacaggccagucaacauagaagcagaaccuccauucggagacagcuacauuaucauaggaguggagccgggacaacugaagcuuaacugguucaagaaaggaaguucuaucggucaaauguuugagacaacaaugagaggagcgaaaagaauggccauuuuaggugacacagccugggauuuuggaucucugggagggguguuuacaucaauaggaaaggcucuccaccaggucuuuggagcgaucuauggggcugccuucaguggggucucauggacuaugaagauccucauaggaguuaucaucacauggauaggaaugaacucacguagcacuucacuguccgugucacuaguauuagugggaaucgugacacuauacuugggagucauggugcaggccgacagugguugcguugugagcuggaagaacaaagaacugaaaugcggcaaugggauauuugucacagauaacgugcauacauggacagaacaauacaaguuccaaccagaauccccuucaaaacuggcuucagcuauucagaaagcucaugaagagggcauuuguggaauccgcucaguaacaagacuggaaaaucuuauguggaaacagauaacaccggaauugaaccacauccuaucagaaaaugaagugaagcugacuaucaugacaggagacauuaaaggaaucaugcagguaggaaaacgaucucugcagccccaacccacugagcugagguauucauggaaaacaugggguaaagcaaaaaugcucuccacagaacuccacaaccagaccuuccuuauugauggucccgaaacagcagaaugccccaacacaaacagagcuuggaauucacuggaaguugaggacuauggcuuuggaguauucaccaccaauauauggcuaaaauugagagagaagcaggauguauuuugugacucaaaacuuaugucagcggccauaaaggacaacagagccguccaugcugauauggguuauuggauagaaagugcacucaaugacacauggaagauagaaaaagccucuuucauugaaguuaaaaguugccacuggccaaagucacacacucuuuggagcaauggagugcuagaaagugagaugauaauuccaaagaaucucgcuggaccagugucacaacacaauaacagaccaggcuauuacacacaaacagcaggaccuuggcaucuaggcaaacuugagauggacuuugauuucugcaaaggaacuacagugguggugaccgaggacuguggaaacagaggacccucuuuaagaacaaccacugccucuggaaaacuuauaacggaauggugcugucgaucuugcacauugccaccguuaagauacagaggugaggauggaugcugguaugggauggaaauuagaccauugaaagagaaagaagaaaaucuggucaauuccuuggucacagccggacaugggcagauugauaauuuuucacuaggaaucuugggaauggcauuguuccuugaagaaaugcucaggacccgagugggaacgaaacaugcaauauuacuagucgcaguuucuuucgugacauuaaucacagggaacaugucuuuuagagaucugggaagagugauaguuaugguaggugccacuaugacagaugacauaggcaugggcgugacuuaucucgcucuacuagcagcuuucaaagucagaccaaccuuugcagcuggacugcucuugagaaaacugaccuccaaggaauuaaugaugacuaccauaggaaucguucuucucucccagaguagcauaccagagaccauucucgaacugacugacgcguuagcccugggcaugaugauccucaagauggugagaaauauggaaaaauaccaguuggcagugacuaucauggccaucuugugcgucccaaaugcugugauauuacaaaacgcauggaaagugaguugcacaauauuggcaguggugucuguuuccccacugcucuuaacauccucacaacagaaagcggauuggauaccaauagcguugacgaucaaaggucucaauccgacagcuauuuuucuaacaacccuuucaagaaccaguaagaaaaggagcuggccauugaaugaggccauuauggcagucgggauggugagcauauuggccaguucucucuuaaagaaugacauccccaugacaggaccacugguggcuggagggcuccuuacugugugcuacgugcugacuggacgaucggcugauuuggaauuggagagagcugccgacgucaaaugggaagaccaggcagagauaucagggaguaguccaauccugucaauaacaauaucagaagauggcagcaugucaauaaagaaugaagaggaagaacaaacacugaccauacucaucagaacaggacugcuggugguuucagggcuuuuucccgugucaguaccaauuacagcagcagcaugguaucugugggaagugaagaaacaacgggcuggaguauugugggacguccccucacccccgccagcgggaaaagcugaauuggaggauggagccuauaggauuaagcaaaaaggaauucuuggauauucucagaucggagccggaguuuacaaagaaggaacauuccacacaauguggcaugucacacguggggccguccuaaugcacaaagggaagaggauugaaccaucaugggcggacgucaagaaagacuuaauaucauauggaggagguuggaagcuagaaggagaauggaaagaaggagaagaaguccaggucuuggcauuggagccugggaaaaauccaagagccguccaaacaaaaccuggccuuuucaaaaccaacaccggaaccauaggugcuguaucucuggacuuuucuccugggacaucaggaucuccaauugucgacaaaaaaggaaaaguugugggucucuauggcaauggugucguuacaaggaguggagcauaugugagugccauagcucaaaccgaaaaaagcauugaagacaauccagagauugaagaugacaucuucagaaagagaagacugaccaucauggaccuccacccaggagcaggaaagacgaagagauaccucccggccauagucagagaggccauaaaaagaggcuugagaacacuaauccuagcccccaccagaguuguggcagcugaaauggaggaagcccuuaggggacuuccaguaagauaccaaaccccagcuaucagggcugagcacaccgggcgggagauuguggacuuaaugugucacgccacauuuaccaugaggcugcuaucaccaaucagagugccaaacuacaacuugaucaucauggacgaagcccacuuuacagauccagcaaguauagcagcuaggggauacaucucaacucgaguggagaugggcgaggcagcuggaauuuuuaugacagccacuccuccgggcagcagagauccauucccucagagcaacgcaccaaucauggacgaagaaagagaaauuccugaacguucauggaauucuggacaugagugggucacggauuucaaaggaaagacugucugguuuguuccaagcauaaaaaccggaaaugacauagcagcuugccugagaaagaauggaaagagggugauacaacucaguaggaagaccuuugauucugaauacaucaagacuagaaccaacgauugggauuucguggucacaacugacaucucggaaaugggcgcuaacuucaaggcucagaggguuauagaccccagacguugcaugaaaccgguuauacugacagacggugaagagcgggugauucuagcaggacccaugccagugacccacucuagugcagcacaaagagggagaguaggaaggaauccaaaaaaugaaaaugaccaguauauauacaugggggaaccuuuggaaaaugaugaagacugugcgcacuggaaggaagccaagaugcuccuagacaacaucaacacaccugaaggaaucauuccuagcauguucgagccagagcgugagaagguagaugcuauugauggugaguaccgcuugagaggagaagcaaggaaaacuuuuguggaccugaugagaagaggagaccuaccaguuugguuggcuuauaaaguggcggcugaaggcaucaauuacgcagacagaagaugguguuuugacggaaccagaaacaaucaaaucuuggaagagaauguggaaguagagaucuggacaaaagagggggaaaggaagaaauugaaaccuagaugguuggaugcuaggaucuaugcugacccacuggcgcuaaaagaauucaaggaauucgcagccggaagaaagucccugaccuugaaccuaaucacagaaauggguaggcucccaacuuucaugacucagaaggucagagaugcacuggacaacuuagcgguguugcacacggcugaagcagguggaaaggcauacaaucaugcucucaaugaacuaccggagacccuggagacauugcuuuugcugacacuuuuggcuacagucacggggggaauuuuucuauucuugaugagcggaagggguauagggaagaugacccugggaaugugcugcauaaucacggcuaguauccucuuaugguaugcacaaauacaaccacacuggauagcagcuucaauaauauuggaguucuuucucauagucuugcucauuccagaaccagaaaagcagaggacaccccaggacaaccaauugacuuaugucgucauagccauccucacagugguggccgcaaccauggcaaacgaaauggguuuccuggaaaaaacaaagaaagaucuuggauugggaagcauuguaacucagcaacccgagagcaacauucuggacauagaucuacgcccugcaucagcauggacgcuguaugccguggccacaacauuuaucacaccaauguuaagacacagcauugaaaacuccucaguaaaugugucccuaacagccaucgcuaaccaagcuacaguguuaaugggucuugggaaaggauggccauugucaaagauggacauuggaguuccccuucucgcuauuggguguuauucacaagucaaccccauaacccucacagcggcucuuuuuuuauugguagcacacuaugccaucauaggcccaggacuccaagcuaaagcaacuagagaagcucagaaaagagcagcagcgggcaucaugaaaaacccgacuguggauggaauaacagugauagaccuagauccaauacccuaugauccaaaguuugaaaagcaguugggacaaguaaugcuccuaguccucugugugacucaaguguugaugaugaggacuacgugggcuuugugcgaggccuuaacucuagcaaccgggcccguauccacauugugggaaggaaauccaggaagguucuggaacacaaccaucgcaguaucaauggcaaacauuuuuagagggaguuaccuagcuggagcuggacuucucuuuucaaucaugaagaacacaaccagugcgaggagaggaacuggcaacauaggagaaacucuaggagagaaauggaaaagccggcugaacgcuuuggggaaaagugaauuccagaucuacaagaaaaguggaauucaagaaguggacagaaccuuagcaaaagaaggcauuaaaagaggagaaacggaucaucacgcugugucgcgagguucagcaaaauugagaugguucguugaaagaaaucuggugacaccagaagggaaaguaguggaccuugguugcggcagagggggcuggucauacuauugugggggacugaagaauguaagagaaguuaaaggccugacaaaaggaggaccaggacacgaagaacccauccccaugucaacauauggguggaaucuaguacguuuacagaguggaguugacguuuucuucauuccgccagagaggugugacacauuguugugugacauaggagaaucgucaccaagucccacgguagaagcaggacgaacacuuagaguccuuaaucugguagaaaauuggcugagcaacaacacucaauuuuguguaaaaguucuuaacccguauaugcccucagucauugaaaaaauggaagcccugcaacggaaacacggaggagccuuggugagaaacccacucucacgaaacuccacacaugagauguacuggguguccaaugcuuccgggaacauagugucaucagugaacaugauuucaagaauguugauuaacagauuuacuaugagacacaagaaggccacuuaugagccagauguugaccuuggaagcggaacccgcaauauuggaauugagagugagacaccaaaccuagacauaauugggaaaagaauagaaaaaauaaaacaagagcaugaaacaucauggcacuaugaccaagaccacccauacaaaacaugggcuuaccauggcaguuaugaaacaaaacagacuggaucagcaucauccauggugaacggaguagucagacugcuaacaaaacccugggacguuguucccauggugacacagauggcaaugacagacacaacuccuuuuggacaacagcgugucuuuaaggagaagguggauacgagaacccaagaaccgaaagaaggcacaaaaaaauuaaugagaaucacggcagaguggcuuuggaaagaacuaggaaagaaaaagacaccuagaaugugcaccagagaagaauucacaaaaaaggugagaagcaaugcagcccugggggccauauucacugaugagaacaaguggaaaucggcgcgugaggcuguuggagaugguagguuuugggagcugguugacaaggaaaggaaucuccaucuugaaggaaagugugaaacauguguguacaacaugaugggaaaaagagaaaagaaacuaggggaguuuggcaaagcaaaaggcagcagagccauaugguacauguggcuuggagcacgcuucuuagaguuugaagcccugggauucuugaaugaagaccauugguucuccagagagaacucccugaguggaguggaaggagaagggcugcacaagcuaggauacaucuuaagagaagugagcaagaaagagggaggagcaauguaugccgaugacaccgcaggcugggacacaagaaucacaauagaagaccugaaaaaugaagaaaugauaacgaaccacauggaaggagaacacaagaaacucgcugaggccauuuucagauugacguaucaaaacaagguggugcgugugcaaagaccaacaccuagagguacaguaauggauaucauaucaagaagagaccaaagggguaguggacaaguugguaccuauggccucaacacuuucaccaacauggaagcacaacuaaucagacagauggagggggaaggaguuuucaaaagcauccagcacuugacagccgcagaagaaauugcugugcaaaauugguuggugagaguagggcgugaaagguuaucaagaauggccaucaguggagaugauugcguugugaaaccucuagaugauagauuugcaagagcucuaacagcucuaaaugacaugggaaagguuaggaaggauauacaacagugggaaccuucaagaggauggaacgacuggacacaagugcccuucuguucacaccauuuucaugagcuaaucaugaaagacggccgcauacucguaguuccauguagaaaccaagaugaauugauuggcagagcccgaauaucccagggagccgggugguccuuacgggaaacggccuguuugggaaagucuuaugcccaaauguggagcuugauguauuuccacagacgugaucucaggcuagcggcaaaugcuauuugcucggcagucccaucacacugggucccaacaagucgaacaaccugguccauacacgccagccaugaauggaugacgacggaagacauguugacagucuggaacaggguguggauucaagaaaauccauggauggaagacaaaacuccaguggaaucaugggaggaaaucccauacuugggaaaaagagaagaccaauggugcggcucacugaucgggcugacaagcagggcuaccugggcgaagaacauccagacagcaauaaaucaagucagaucccucauuggcaaugaagaauauacagauuacaugccauccaugaaaagauucagaagagaagaggaagaggcaggaguuuugugguag

SEQ ID NO: 7130 - RNA, 9876 nt, Artificial Sequence
  derived and/or modified CDS sequence (wt) from DENV-2__KF479233__SS-prME
acugcgggcgugaucaucaugcuaauuccaacagcgauggcguuucauuuaaccacacgcaacggagaaccacacaugaucgucagcagacaagagaaagggaaaagucucuuguucaaaacagaggauggugugaacauguguacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacaugcccagagaauugaaaccuggaucuugagacauccagguuuuaccauaauggcagcaaucuuggcauacaccauaggaacgacauacuuccaaagaguccugaucuucaucuuacugacagcugucgccccuucaaugacaaugcguuguauuggaauaucaaauagagacuuuguggaagggguuucaggaggaagcuggguugacauagucuuagaacauggaagcugcgugacaacgauggcaaaaaacaaaccaacauuggacuuugaacugauaaaaacagaagccaagcaaccugccacucuaaggaaguacuguauagaagcaaagcugaccaacacaacaacagcaucucgaugcccaacacaaggagaacccagccuaaaugaagaacaggacaaaagguuugucugcaaacauuccaugguagacagaggauggggaaauggauguggauuauuuggaaagggaggcaucgugaccugugcuauguucacaugcaaaaaaaacauggaaggaaaaauugugcaaccagaaaaccuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccucgacuucaaugaaaugguguugcugcaaauggaaaauaaggcuuggcuggugcauaggcaaugguucuuagaccugccguuaccaugguugcccggagcggacacacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuaugugcacaggaaaguuuaaaguuguaaaggaaauagcagagacacaacauggaacaauaguugucagaguacaauaugaaggggauggcucuccauguaaaaucccuuuugagauaauggauuuggaaaaaagacaugucuuaggucgccugauuacagucaacccaaucguaacagaaaaagacaguccagucaacauagaagcagaaccuccauuuggagacagcuacaucauuauaggaguagaaccgggacaacugaagcucagcugguuuaaaaaaggaagcucaaucggccaaauguucgagacaacaaugagaggagcgaagagaauggccauuuuaggugacacagccugggauuuuggaucccugggaggaguguucacaucuauaggaaaggcccuccaccaagucuuuggagcaaucuauggggcugccuucaguggggucucauggacuaugaaaauucucauaggaguugucaucacauggauaggaaugaauucacguagcaccucacugucugugucacuaguauuagugggagucgugacauuguauuugggaguuauggugcaggcugauagugguuguguugugaguuggaaaaacaaagaauugaaauguggcagugggauuuuuaucacagacaauguacacacauggacagaacaauacaaauuccaaccagaaucccccucaaagcuggcuucagcuauccagaaagcucaugaagagggcauuuguggaauccgcucagugacaagacuagagaaucuaauguggaaacaaauaacacccgaacugaaucacauccuaucagaaaaugagguaaagcugaccaucaugacaggagacaucaaagguaucaugcaggcaggaaaacgaucccugcggccucagcccacugagcugaaguauucauggaaaacguggggcaaagcgaaaaugcucuccacagagccucaaaaccagaccuuucucauugauggccccgaaacagcagaaugucccaacacaaacagagcuuggaacucacuagaaguugaagacuauggcuuugggguauucaccaccaacauauggcugaaguugaaagagaggcaggauguguuuugugacucaaaacucaugucagcggccauaaaagacaacagagccguccaugccgauauggguuauuggauagaaagcgcacuuaaugacacauggaagauagaaaaagcuucuuuuauugaagucaaaaguugccacuggccaaaaucacacacucucuggagcaauggagugcuagaaagugagaugauaauuccaaagaauuuugcuggaccaguaucacaacacaauuacagaccaggcuaucacacacaaacggcaggacccuggcaucuaggcaagcuugagauggacuuugauuuuugcgaaggaaccacagugguggugacugaagacuguggaaauagaggacccucucuaagaacaacuaccgccucuggaaaacucauaacagaauggugcugccgauccugcacauuaccaccacuaagauacaaaggugaggauggaugcugguacggaauggaaaucagaccauugaaggagaaagaagagaacuuggucaacuccuuggucacagccggacauggacagauugacaacuucucacuaggggucuugggaauggcacuguuccuggaagaaaugcucaggacccgcguaggaacaaagcaugcaguauuacuaguugcaguuucuuucaugacauugaucacagggaacaugucuuuccgagaccuggggagagugauggucauggugggggcugcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaauuguacuccucucccagagcaccauaccagagaccauacuagaacugacugacgcguuggccuugggcaugaugauucucaagauagugaggaauauggaaaaguaucaauuagcagugacuaucauggcuaucuuauguguuccaaaugcagugauauuacaaaaugcauggaaagugagcugcacaauacuggcagugguguccguauccccacugcucuuaacaucuucacagcagaaagcggauuggauaccauuggcauugacgaucaaaggucucaauccaacagccauuuuccuaacaacccuuucaagaacuaacaagaaaaggaguuggccacuaaaugaggcuaucauggcaguagggauggugagcauuuuagccaguucucucuugaagaaugauauucccaugacaggaccacugguggcuggagggcuucucacuguguguuacgugcucacuggaagaucggccgacuuggaacuggagagagccgccgacguaagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuucccguaucaauaccaauuacggcagcagcaugguaccugugggaagugaagaaacaacgggcuggaguauugugggauguuccuucacccccaccugugggaaaggccgaacuggaagauggagcuuauagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaaaacuaacaccggaaccauaggugcugugucucuagacuuuucuccuggaacgucaggauccccaauugucgacaaaaaaggaaaggucgugggucucuauggcaauggugucgucacaaggaguggaacauaugugagugccauagcccagacugaaaaaagcauugaagacaauccagagauugaagaugauaucuuucggaaaaaaagauuaaccaucauggaccuccacccaggagcgggaaagacgaaaagauaccuuccagcaauagucagagaggccauaaaacgaggcuuaagaacauuaauccuggcccccaccagagucguggcagccgaaauggaagaagcucuuagaggacuuccaauaagauaccaaaccccagccauuagagcugagcacacugggcgagaaaucguggauuuaaugugucaugccacauuuaccaugaggcuguuaucaccaguuagagugccaaauuacaacuugauuauuauggaugaagcccauuucacagacccagcaagcauagcagccagaggauacauuucaacucgaguggagaugggugaagcagcugggauuuucaugacggccacuccuccgggaagcagagacccauuuccucaaagcaaugcaccaaucauggaugaagaaagggaaaucccugaacguucguggaacucuggacaugaguggguuacagauuuuaaagggaagacuguuugguuuguuccgaguauaaaagcaggaaaugauauagcagcuugccugagaaaaaauggaaagaaagugauacagcuuaguaggaagaccuuugauucugaauacaucaagaccaggaccaaugauugggauuuuguggucacgacugacauuucagaaaugggugcuaacuucaaggcugaaaggguuauagaccccaggcgcugcaugaagccagucauauugacagacggugaagagcgggugauccuggcaggacccaugccagugacucacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaaaguggaugccauugauggugaauaccgcuuaagaggagaagcgaggaaaaccuuuguggagcuaaugagaagaggagaccuaccagucuggcuggccuacagaguggcagccgaaggcaucaacuaugcagauagaaggugguguuuugauggaaucaagaacaaccaaaucuuggaagaaaauguggaaguggaaaucuggacaaaagaaggagaaaagaagaaacugaaacccagaugguuggaugcuaggaucuacucugacccacuggcgcucaaagaauucaaagaguuugcagcuggaagaaaaucccugaccaugaauuuaaucacagaaauggguaggcucccaacuuuuaugacucagaaagcaaggaacgcacuggacaacuuagcaguccugcauacagcugaagcaggcggaagggcguacaaucaugcucucagugaacugccagagacccuggagacauugcuuuugcucacgcucuuggccacagucacgggcggaaucuuuuuauucuugaugaguggaaaaggcauagggaaaaugacccugggaauguguugcauaauuacggccagcauucuccuaugguacgcacaaauacagccacacuggauagcagcuucaauaauacuggaguuuuuucucauagucuugcucauuccagagccagaaaaacaaagaacaccccaagacaaccaauugacuuauguugucauagccauccucacagugguggccgcaaccauggcaaacgagaugggguuccuggaaaaaacgaaaaaagauuucggauuggggagcauuguaacccagcaacccgagagcaacauucuggacauagaucuacguccugcaucagcauggacccuguaugcaguggccacaacauuuaucacaccaauguugagacauagcauugaaaauuccucagugaaugugucucuaacagccauugccaaucaagccacagugcuaaugggucuugggaagggauggccauugucaaaaauggacauuggaguuccccuucucgccaucgggugcuauucacaagucaaccccauaacccuuacagcagcccuucuuuuauugguagcacacuaugcuaucauagggccaggacuccaagcaaaagcaaccagagaagcgcagaaaagagcagcagcaggcaucaugaaaaacccaacuguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauuuuggaacacaaccauugcagugucaauggcuaacauuuuuagaggaaguuaccuagcuggagccggacuucucuuuuccaucaugaagaacacagccaacacaagaaggggaacugguaacacaggagagacgcuuggggaaaaauggaaaaaccgauugaauucauuggggaagagugaauuccagauuuacaagagaagcggaauccaggaaguggauagaaccuuggcaaaagaaggcauuaaaagaggagaaacggaccaucacgcugugucgcgaggcucagcaaagcugagaugguucgucgagagaaaccugguuacaccagaggggaaagugauggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccgccagaaaagugugacacauuguugugugauauaggggagucgucaccaaaucccacgguugaagcaggacgaacacuuagaguccuaaacuugguagagaauuggcugaacaacaacacccaauuuugcauaaagguucuaaacccauacaugcccucagucaucgaaaaaauggaaacgcugcaaaggaaauacggaggagcuuuggugaggaauccacucucaagaaauuccacacaugagauguauuggguauccaaugcuuccgggaacauagugucaucagugaacaugauuucaaggauguugaucaauagauucacaaugagacauaagaaggccacauacgagccagauguugaccucggaagcggaacccgcaacaucggaauugaaagugagauaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaagacaccuagaaugugcaccagagaagaauucacaagaaaggugagaagcaaugcagcccuaggugccauauucacugaugagaauaaguggaagucggcacgugaggcuguugaagacaguagauuuugggaacugguugacaaggaaaggaaucuccaucuugaaggaaagugugagacauguguguacaacaugaugggaaagagagagaagaagauaggagaauucggcaaagcaaaaggcagcagagccauaugguacauguggcuuggagcacgcuucuuagaguuugaagcccugggauuccugaaugaagaucacugguuuuccagagagaacucucugagcggaguggaaggagaagggcugcacaagcuggguuacauucuaagagaagugagcaaaaaagaaggaggagcaauguacgccgacgacacagcaggaugggacacaagaaucacacuagaggacuuaaaaaaugaagaaauggugacaaaccauauggaaggagaacacaagaaacuugcugaggccauuuucaaguuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagaaggagucuuuaaaagcauccagcaucugacaaccacagaagaaguagcagugcaagacugguuagcaagaguggggcgugagagguuaucgagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcggcuaacgcuauuugcucggcagucccaucacacuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguugacaagcagagccaccugggcaaagaacauccaaacagcaauaaaccaaguuagauccuuaauaggcagugaggaauacacagacuauaugccauccaugaaaagauucagaagagaagaggaagaggcaggggucuugugguag

SEQ ID NO: 7131 - RNA, 9876 nt, Artificial Sequence
  derived and/or modified CDS sequence (wt) from DENV-2__KX372564__SS-prME
acugcagguauaauuauuaugaugaucccaacagugauggcguuccauuuaaccacacgcaauggagaaccacacaugaucgucaguagacaagagaaagggaaaagucuucuguuuaaaacagagaacggugugaacaugugcacccucauggccauggaucuuggugaacugugugaagacacaaucacuuacaauuguccucuucucaggcagaaugaaccagaagacauagacuguuggugcaacucuacgucuacauggguaacuuaugggacaugcaccgcuacaggagaacacagaagggaaaaaagaucaguggcacucguuccacaugugggaaugggacuggagacacgaacugaaacauggaugucaucagaaggggccuggaaacaugcacagagaauugaaacuugggucuugagacauccaggcuucaccauaauggcagcaauccuggcauacaccauaggaacgacauauuuccaaagaguccugauuuucaucuuacugacagcuguugcucccucaaugacaaugcguuguauaggaauaucaaauagagacuuuguggaagggguuucaggaggaagcuggguugacauaguccuggaacauggaagcugugugacgacgauggcaaaaaauaaaccaacauuggauuuugaacugauaaagacagaagcgaaacaucccgccacucuaaggaaguauugcauagaggcaaagcugaccaacacaacaacagcaucucgcugcccaacacaaggagaaccuagccuaaaugaagaacaggacaaaagauuugucugcaaacacuccaugguagauagaggauggggaaauggaugcggauuauuuggaaagggagguaucgugaccugugcaauguucacaugcaaaaagaacauggaagggaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguucuaggaucccaagaaggggcuaugcacacagcacuuacaggggccacggaaauccagaugucaucaggaaacuuacuguucacaggacaucuuaaauguaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccgggacaacugaagcucagcugguuuaagaaaggaagcucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacguagcacuucacugucugugucacuaguauuagugggagucgugacauuguauuugggaguuauggugcaggccgauagugguugcguugugagcuggaaaaacaaagaacugaaauguggcagugggauuuuuaucacagacaacgugcauacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaacagaaaaugagguaaaguugacuaucaugacaggagacauuaaaggaaucaugcaggcaggaaaacgaucccugcggccucaacccacugagcugaaguacucuuggaaagcauggggcaaagcgaaagugcucuccacagagcuucauaaccacaccuuucucauugauggccccgaaacagcagaaugucccaacacaaauagagcuuggaacucacuagagguugaggacuauggcuuuggaguauucaccacuaacauauggcugaaauugaaagaaaggcaggauguaucuugugacucaaaacucaugucggcagccauaaaagacaacagagccguccacgccgacauggguuauuggauagaaagcgcacucaaugacacauggaagauugagaaagccuccuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaagacuguggaaauagaggacccuccuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggaguccugggaauggcauuguuccuggaagagaugcuuagaacccgaguagggacgaaacaugcaauauuacuaguugcagucucuuucgugacauugaucacagggaacauguccuuucgagauuuggggagagugauggucauggugggcgcuacuaugacggaugacauaggcaugggcgugaccuaucuugcccuauuagcagccuucaaggucagaccaacuuuugcagcuggacuacucuuaagaaagcugaccuccaaggaauugaugaugaccaccauaggaaucguacuccucucucagagcaccauaccagagaccauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacagcacuggcagugguguccguuuccccacugcuuuuaacaucuucacagcagaaaacggauuggauaccacuggcguugacgaucaaaggccuuaauccaacagccauuuucuuaacaacccucucaagaacuaguaagaaaaggagcuggccacuaaaugaggcuauuauggcagucgggauggugagcauuuuagccaguucuuucuuaaagaaugacauucccaugacaggaccacuaguggcuggagggcuucucacuguguguuacgugcucacuggaagaucggcugauuuggaacuggagagagcugcugacauaagaugggaagaacaggcagagauaucaggaagcaguccaauuuugucgauaacaauaucggaagauggcagcaugucgauaaaaaaugaagaagaagaacaaacacugaccauacugauuagaacaggacugcuggugauaucaggacuuuuucccgugucaauaccaaucacggcagcugcaugguaccugugggaagugaaaaaacaacgagccggaguauugugggaugucccuucaccuccaccugugggaagggccgaacuggaagacggagccuauagaaucaagcagaaagggauuuugggauacucgcagauaggagccggagucuacaaagaaggaacuuuccacacaauguggcaugucacacguggugcuguucuaaugcauaaagggaagagaauugaaccaucaugggcggacgucaagaaggaccuaauaucguauggaggagguuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuuccccuggaacgucaggaucuccaauugucgacaaaaaaggaaaaguugugggccuuuauggcaacggugucgucacaaggaguggaacauacgugagugccauagcccagacugaaaaaagcauugaagacaacccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagagucguggcggcugaaauggaagaagcucucagaggacuuccaauaagauaucaaaccccagcuaucagagcugagcauacuggacgggagauuguggaucuaaugugucacgccacauuuaccaugaggcuacuaucaccaauuagagugccaaauuacaaccugauuaucauggaugaagcccauuucacagacccagcaagcauagcggcuagaggauacaucucaacucgaguagagaugggugaagcagcugggauuuuuaugacagccaccccuccuggaagcagagacccauuuccucagagcaacgcaccaaucauggaugaagaaagggaaauuccugagcguucguggaacucuggacaugaguggguuacggauuuuaaagggaagacuguuugguuuguuccaaguauaaaagcaggaaaugauauagcagcuugccugagaaagaaugggaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagaacggguuauccuggcaggacccaugccagugacccacucuagugcagcacaaagaagagggagaguaggaagaaauccaaaaaaugaaaaugaccaguauauauacaugggggaaccucuggaaaaugaugaagacugcgcacacuggaaagaagcuaagaugcuucuagauaacaucaacacgccugaaggaaucauucccagcauguuugaaccagagcgugagaaggucgacgccauugauggugaauaccgcuugagaggagaagcgaggaaaacauuuguggaccuaaugagaagaggagaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcacuuaaagaauucaaggaauucgcagcuggaagaaaaucccugacccugaaucuaaucaccgagauggguaggcucccaaccuucaugacccagaaagcaaggaaugcauuggacaacuuagcaguccuacacacggcugaagcaggcggaagggcguacaaucaugcucuuagugaacugccggagacucuggagacauugcuuuuacugacacuuuuggccacagucacaggcggaaucuuccuguucuugaugagcggaaaggguauagggaagaugacccugggaaugugcugcauagucacagccaguauucuucuaugguaugcacaaauacagccacauuggauagcagcuucaauaauacuggaguuuuuucucauagucuugcucauuccagaaccagaaaagcagagaacaccccaagauaaccaauugacuuauguugucauagccauccuuacagugguggccgcaaccauggcaaaugagauggguuuccuggaaaaaacaaagaaagauuucggauugggaagcaucacaacccagcaaccugagagcaacauccuggacauagaucuacguccugcaucagcuuggacucuauaugcuguggcaacaacuuucaucacaccaauguugagacauagcauugaaaauuccucagugaaugugucucuaacagccauugccaaccaagccacaguguuaaugggucuugggaaaggauggccauugucgaaaauggacaucggaguuccccuucucgcuaucggaugcuauucacaagucaaccccauaacccucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauaccauaugauccaaaguuugaaaagcaguugggacaaguaaugcucuuaguccucugcgugacucaaguauugaugaugaggacuacaugggcuuuaugugaagcucuaacuuuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagaaacgcuuggagagaaauggaaaaaccgguugaaugcauuggggaagagugaauuccagaucuauaagaaaaguggaauccaggaaguggauagaacguuagcaaaagaaggcaucaagagaggagaaacggaccaucacgcugugucgcgaggcucagcgaaacugagaugguucgucgagagaaaccuugucacaccagaagggaaaguaguggaccuuggcugcggcagggggggcuggucauacuauugugggggacuaaagaauguaaaggaagucaaaggccuaacaaaaggaggaccaggacacgaagaacccauucccaugucaacauaugguuggaaucuggugcgucugcaaaguggagucgaugucuuuuuuacuccgccagaaaagugugacacauugcugugugacauaggggaaucgucaccaaaccccacggucgaggcaggacgaacacucagaguucuaaacuuaguggaaaacuggcugaacaauaauacccaauuuugcauaaagguucuuaauccauauaugccuucaguuauagaaaaaauggaagcacuacaaaggagauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaggccacauacgagccggauguugaucucggaaguggaacccgcaacaucggaauugaaagugaaguaccaaaucuagacauaauugggaaaagaauagaaaaaauaaaacaagagcaugaaacaucauggcacuaugaucaagaccacccauacaaaacgugggccuaccauggcagcuacgaaacaaaacagacuggaucagcaucauccauggugaacggagugguuaggcugcuaacaaaaccuugggacgucauccccauggugacacagauggcaaugacagacacgacuccauuuggacaacagcgcguuuucaaagagaaaguggacacgagaacccaagaaccaaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaagcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuggaguuugaagcccugggauucuugaaugaagaucacugguuuuccagagagaacucccugaguggaguagaaggagaagggcugcacaaacuaggcuacauucuaagagacgugaguaagaaagaaggaggagcaauguacgccgaugacaccgcaggaugggacacaagaaucacgcuagaggacuugaaaaaugaagaaauggugacaaaccacauggaaggagaacacaagaaacuugcugaagccauuuucagauuaacguaccaaaacaaaguggugcgugugcaaagaccgacaccaagaggcacaguaauggacauuauaucgagaagagaccaaagagguaguggacaaguugucaccuacggccucaacacuuucaccaacauggaagcccaacugaucagacagauggagggagaaggagucuucaaaagcauccagcaccugacagccacagaagaaauugcagugaaaaacugguuaguaagaguggggcgugagagguuaucaagaauggccaucagcggagaugauuguguugugaaacccuucgaugacagguuugcaaacgcucuaacagcuuuaaaugacaugggaaaggucaggaaagacauacaacaaugggaaccuucaagaggauggaacgauuggacacaagugcccuuuuguucacaccauuuccaugaguuaaucaugaaggacggucguguacuugugguuccauguagaaaccaagaugaacugauugguagggcccgaauuucccagggagccgggugguccuugcgggaaacagcuuguuuggggaagucuuacgcccaaauguggagccuaauguacuuccacagacgugaccuuaggcuggcggcaaacgcuauuugcucggcagucccuucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaagaaaucccauauuuggggaagagagaagaccaguggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7132 - RNA, 9873 nt, Artificial Sequence
  derived and/or modified CDS sequence (wt) from DENV-2__KX274130__SS-prME
ucugcagcuacacuacucuuguugguuccaacaauuauggcuuuucaccugacgacacgaaacggugagccgcacaugauaguggcccgccaugaaaaagggaagagccugauauucaagacagagaauggggugaacaugugcacauuaauggcuauggaccuaggagaacugugugaggaaacaguuacauacaaaugcccauacuugaagcaaagugaaccagaagacauagacugcuggugcaacacaacauccaccuggguuacauauggaacaugcagcucaucaggagaacacagaagggaaaaaagaucaguggcccucgccccgcacgugggcaugggacuggaaaccagaacagaaacauggauguccucagaaggagcauggaaacaugcccagcgaauugaaaacuggauauuacggcacccaggguauacagucauggcggccgcuauugcaauggccauuggaaccaacaauuuccaaagggcacugauauucgugcuauugacagcuguggcuccaucaaugacaaugcgcugcgugggcauugccaacagagacuucguugaggggguuucggguggaagcuggguugacauugucuuggaacauggaagcuguguaacaacaauggcaaagaacaaacccacauuggacuuugaguugacaaagacagaagccaaacuaccagccacuuugcggaaauacugcauagaggcuaagcucacaaauaccacuacugaaucaagaugcccaacacagggagaacccagccuaccagaagaacaagacaaaagauucauauguagacacucacuaguggauagaggcuggggcaauggaugugguuuauuuggaaagggugggauagugacaugugccauguuuacaugcaagaaauacauggaggggaaaauaguccaaccagaaaaccuggaauacacagucgccguaacaccacacucaggggaggaacacucaguaggcaaugacacaggaaagcacggacaagacgugaaaauaacaccccagagcucaaucacagaaacagcccuagaaggauaugguuccauaucaauggaauguucaccaaggacaggccucgacuucaaugaaauggugcugcugcagauggaggacaaggcauggcuaguacacaggcaaugguucuuggaccucccccuacccuggcuuccaggcucagacacacaagggucaaauugggugcaaaaggaaacucuggugacauucaagaauccacaugccaaaaaacaagacguaguaguguuaggcucacaagaaggagcgaugcauucagcuuuaacaggagcuacagaaauccaaaugacuucuggaaaccuucuguucacaggacacuugaaaugcaggcugcgaauggacaaacuagaacucaaaggaaugucuuacucaaugugcacuggaaaguucaaaguagugaaggagaucgcagagacucagcauggaacaauaguaauuagaguacaguaugaaggagagggaagcccauguaagauaccuuuugagaucauggacuuagaaaagaaacauguccuaggacgguuaauaacugucaaccccaucaucacagagaaagacaaaccaacaaacauagaggccgaaccgcccuuuggugacagcuacauuuugauuggaguugaaccaggacagcuaaaaaugaauugguuuaaaaaagggaguagcaucggccaaauguucgagacuacaaugagaggagcaaaaagaauggcaauauugggagacacagcaugggacuuuggcucacuagggggaguuuucaacuccauaggaaaagcccuucaccaagucuuuggagcaguguacaacgccgccuucaguggagugucauggacuaugaaaauauuaauuggaguuauuauaacauggauaggaaugaacucccggagcaccucaaugucaaucacauuagucauggugggacuaguaacauuauaccuagggguaguaguucaagcggacaguggguguguggucagcuggaagacuaaagaacugaaauguggcaguggaauuuuugugaccgacaaugugcacguguggacugagcaauacaaauuccaacccgagucgccagccaaacuugcagcugcuauuaaaaaagcucaugaggaagguguuugcgguauaagaucaguuacaaggcuagagaacauaauguggaaacaaauaaccccagaacuaaaucacauccuaacugagaaugacgugaagguuaccaucaugacuggggauauuaagggaauuuugcagcaaggucgacgagcacugagaccgcaaccaacagaauuaaaauauucauggaaaaguuggggaaaaucaaaaauaguuagcucagaaacacauaaccaaacuuuuuuaauagauggaccagaaaccacagaauguccagacaccaaucgagcguggaacucuuuggaaguugaggacuauggauuuggauuguuuucaacgaacauuuggcuacgucucagagaaaagcaagacacacuaugugauucaaagcucaugucagcagcggugaaagacgagagagccauccacgcagacaugggguauuggauagaaagcaaacucaauggcagcuggaagauagagaaagcauccuuucuagaggugaaaagcugcacauggccacgcucccacacuuuauggagcaauggaguguuggagagugaaaugauaauaccaaaaaauuuagguggaccaguaucacaacacaauuauagaccuggcuauuacacacagaccacaggaccuuggcacuuggggaaauuagaaauggacuuugauuauugugaagggacaacagugauagucacagaagagugcaacaauagagggccaucccuacgcacaacaacagccucagggaaguugauaacagaauggugcugcagaucuugcacaaugccccccuugagauucaaaggugaagaugggugcugguauggaauggagauucgaccuuuaaaagagaaagaagaaaaucucgucaauucgcuaguuacugcaggacaugggcagauugacaacuuuucauuagggauucuuggaauagcguuguuuuuagaagaagucaugaagaguagaaucggaaucaaacacacaauaggaaugacaauuauaacuuuccugcuguuaguaacgggaaauguguccuaccgugacuugggcagagugauacugaugguaggcucaacuauggcagacgaaauggggauggggguuacguacuuagcccuccucgcuaccuucagaauaagaccaacuuuugcuuuggcucuuaugauaaggaagcucacgucaaaagaacuacucauggccacaauuggaauuguccucauagcucagugcgacgucccagggacaaucuuggaaauaacagaugcuugugcacugggcuuaauguuacuaaaaaugaccagagaauuggaaagguaccaguuggcagugacauuguugucauugacaugcauaccaaaugcgacaauaauguggggagcguggaaggucacaugcacaauccugacacugguuuccauggccccccuuuuucugacaacauccaggcaaaaaacagacuggguaccggucgcauuaucaaucuaugguuuaaauccaacagcaauauacuucacaacauuagcgaaggcgaagaaaauaaggagcuggccgcuaaaugaagcugugauggcagugggaauggugagcauauuagcaaguucacugcugagaaaugacauaccaauggcaggaccacuaguugcuggaggguugcugacucucugcuacgugcugaccgggaggucagcugaucuagaacuugagaaguccgcugacaucaaauggaaugaugacgcggaaauuucaggaagcagcccgauaauaaauguggcuguaucagaagaugguaguaugucaauaaaagaugaggaagaagaaaacacccucaccauacugauccgcacaggccuuuuagcuaucucaggaauguacccaauggcuauaccagcaacggccgccgugugguauuuuugggaggcaagaaagcagcgagccggaguuuugugggauguuccaagucccccaccaacagggaaagcagaacuggaagagggagccuaccgcaucaaacaacgagguauuuuuggauacucacaaauaggagcaggaguguacaaagaaggaaccuuccacacaauguggcacgugacaagaggaucagugcucaugugcaaagggaaaagacuagaaccaucaugggcugauguaaagaaagacuuaaucucauacggagguggauggagacuggauggagaguggacugaaggugaggaaguccaagugcuagcguuggaaccagggaaaaauccuagggccguacaaacaaaacccggcauguucaaaacugacacaggaagaauuggugcugugucauuggacuuugcuccaggaaccucaggaucccccaucauagacaaaaaagggaaagugauuggacuuuaugggaauggaguggugaugaaaaguggggccuaugugagcuccauagcucaaacugaaaaaagagaagaugaaauaccugaaauagaagaugauaucuucagaaagagaagacucacaauaauggauuuacauccaggggccggaaaaacaaaacgcuaccucccagcaauaguacgugaagcuauaaagagaggucuaagaacucugauccuagcccccacaagggugguggcagcugaaauggaagaagcgcucaggggguugccaauacguuaccagaccccggcaaucagagccgagcauacaggcagggaaauuguggaucuuaugugucaugccacauucacgaugcgucuacugucuccaguaagagugcccaacuacaacuuaaucauaauggaugaagcccacuuuacagaucccgccagcauagcugcuagaggcuacauagcaaccagaguggaaaugggagaggcugccggaaucuucaugacagccacuccucccggaagcaaggacccuuuuccgcagagcaacgcuccaauaauggaugaagagcgcgaaauuccagaacgcucuuggaacucaggucaugaguggauaacagacuuugaagggaaaacagugugguuuguucccagcauaagagcagggaaugauaucgcaacauguuugaggaagaaugggaaaaaggugauccagcuaagucguaaaacuuuugacaccgaauacaucaaaacacgcaacaaugacugggacuuugucgucacaacagacauaucugagaugggggcaaacuucaaggccgaaagagucauagacccaagaaggugcaugaagcccguaauucucacugauggagaggaaagagucauucuugcaggaccgaugccagugacaccaucgagugcggcacagagaaggggcagaauagggagaaauccgaagaaugaaaacgaucaguacauauacaugggagaaccacuagaaaaugaugaagacugcgcccauuggaaagaagcaaagaugcuccuugacaacaucaacacacccgaagggauaauaccagcaauguucgguccugagagggaaaaaacugaugccauagacggagaauaccgucuaagaggagaauccaggaaaacauuuguugaacucaugagaagaggagaccuuccaguguggcuggcauacaagguggcaucagaaggguacaguuaugcggauaggagauggugcuuugaaggagugaaaaacaaccaaauacuggaggagaaccuugagguggagauuuggacaaaagaaggagagaggaaaaaacugagaccaaaguggcuggaugcgcgaacauauucagauccacaggcauugaaagauuucaaggaauucgccgcagggcggaagucuaccacacucaaccuaauugcggagcuuggccguuuaccaacguauaugacacagaaaacgagagaugcccuggauaacuuggcaguuuugcacacagcagaagaggggggaagggcuuaccagcacgcaaucagugaacucccagaaacacuagaaacacuauuguugcucugccuacuggccacaguuucagggggggucuuucuuuuucugaugagugggaaaggaauugguaagaugucaaugggacuuggaugcaucaucacagccagugggcuccuuugguaugcccaaauccagccacacuggauugcagccucuauaauacuagaguucuuucugauuguauugcugaucccugaaccggaaaaacaaagaacuccacaagauaaccagcucacauacguggucauagcaauacuaacgcuaguagcagcaaccauggcaaaugaaauggguuauuuggaaaagaccaaaaaagaucugggauuuggaaacccauauguugccucacaugaagcagcuauucuggacauagaucuacauccagcuucagccuggacauuguaugcaguggccacaacacuaaucacacccaugcuacgacacaguauugaaaacucuucaaccaauguuucauugacagcuauagccaaccaagccacugucuugaugggacuuggaaaaggauggccauugucaagaauggacuuaggggugccuuuacuggcucugggauguuauucacaaguuaacccacugacccugacugcuucccuuuuacuuuuaauagggcacuaugcaauaauaggaccgggucugcaagcuaaggcaacgagagaagcucaaaagaggacagcggccggaaucaugaaaaauccaacaguggauggaauaacaguuauagacauugaaccaauuccauacgacccaaaguuugaaaaacaacuaggacagguaaugcucuugguucucugcguggcccagguguugaugaugagaacgacaugggcuaugugugaagcauuaacaauagcaacgggcccuauaucaacauuaugggaaggaaacccuggaaaauucuggaacacaacaauagcaguauccauggcuaauauauucagaggaaguuaccuggcaggagcaggacuucuauucuccauaaugaaaaacacagucacuggaagacggggaacuggaguggccggagagacucuuggagagaaauggaaaaucaaauuaaauggauuagggagaacggauuuucagacauacaaaaggaguggcauaauugaaguggacagaacacuagccaaagaagguaucaagagaggagaaaccaaccaccacgcagugucgagggguucagcgaaacugagaugguucguggagagaaaucuagugaaaccagaaggcaaaguaauugaccugggcugugguagaggaggcuggucuuacuauuguggaggucuaaaaaauguaaccgaagugaaaggucugacgaaaggagguccaggacaugaagaacccaucccaaugucaacuuacggauggaaucucguacggcuacaaaguggcguggauguguuuuuuacaccuccagagaaaugugacacuuugcugugugauauaggagaaucaucaccaaauccaaccaucgaagccgggagaacacuuaggguuuugaauaugguagaaaauuggcugggcaacaaucaauucugcauaaaaguacucaacccauacaugccaucugugauugagaagauggaaaacuugcaaaggaaguucgguggaacacuggugagaaacccacucucacgaaacucaacacaugaaauguacuggguguccaaugcuaguggaaacauaguaucuucugucaauaugaucuccagaaugcucaucaacagguucaccaugaaacauaaaaaaccgacauaugaacaggauguggaucuaggcaguggaacaagaaaugugggcauugagaccgaaaaacccaaucuugaaauuauagggaagagaauugagaaaauaaaagaugagcacaagcagacauggcauuaugaccuggaccacccguacaagacaugggccuaucaugggaguuaugaaacaaagcaaacuggaucagccucuucgaugaucaauggcguaguaaaacuccucacaaaaccaugggaugugauucccauggugacccagauggcaaugacagacacaacaccauuuggacagcaaagagucuucaaggaaaaaguugauacaagaacuccagaacccaaagaaggaacaaagaaacucaugaaguugacggcaaaguggcugugggcggaacugggaagacacaaagugccuaggaugugcacaagagaugaauucacaaacaagguuaggagcaaugcagccaugggagcaguuuuuacugaagaaaauagauggagcucagcaaaagaagcuguggaggaugaagccuucugggaucucguagauagagagagaaagcuacacuugcaaggaaagugugagacgugugucuacaacaugauggggaaaagagaaaagaaacuaggagaguuuggaagggcaaaggguagccgggccaucugguacauguggcuaggagcaagauuucuggaauucgaagcacucggcuuccucaaugaagaucauugguuuuccagggagaauucacucaguggaguagaaggagaagggcugcacaaacugggauacauccuuagagaaauuggggcaaaagauggaggaaugauguacgcagaugacacagccggaugggacacacgugucacagaagaagauuuaaagaaugaagagaugauaucggaacagaugaaaggugagcauaggacacuggcugaggcuauuuucaaauuaaccuaccaaaacaaaguagucagaguccaacgucccaccccgaaaggcacagugauggacaucauuucacgcagagaccaacguggaaguggacaaguaggcaccuauggauuaaacacuuuuaccaacauggaagcacagcucauuaggcaaauggaaggggaaggucuguucagggacauaucuaaauugaccauccaggaagaaacagcuauccuuaccuggcugaaggaaaaagggcgugauagacugagucguauggccaucaguggagaugauuguguggucaaaccaguugaugacagguucgcccaugcccucacagcccugaaugacauggggaaaguaaggaaagacauacaacaaugggaagcauccaaggguuggaaugacuggacacaaguccccuuuugcucacaccauuuccaugagauaaucaugaaagacgggagaaaacuggugguccccugccgaaaccaagaugaacucauagggagagcuagaaucucucaaggggcuggaugggcauugaaagagacagccugucuagggaaagccuaugcacaaauguggagccuuauguacuuccaccgaagagaucuaagacuagcagcaaaugccauuugcucagcugucccaucccacuggguuccgacaagucgaaccacuugguccauccaugcacaucaucaauggaugacaacugaggacaugcuagacguauggaacagaguguggauacuggaaaacccuuggauggaugacaaaacuugcgugaagucaugggaggaaguuccguacuuagggaaaagagaggaccaaugguguggcucacucauaggauugaccagcagggcaacaugggcaaagaacauaaaaguggcaauugagcaagugagauccuuaauagggaaagaagaauacacugacuacaugcccuccaugaaaagguucaagcaggaacagagcacagaaggagcacugugguga

SEQ ID NO: 7133 - RNA, 9876 nt, Artificial Sequence
  derived and/or modified CDS sequence (wt) from DENV-2__GU289914__SS-prME
ucugcaggcaugaucauuauguugauuccaacagugauggcguuccaucuaaccacacguaacggagaaccacacaugaucgucaguagacaagagaaagggaaaagucuucuguuuaaaacagaggauggugugaacaugugcacccucauggccauggaccuuggugaauugugugaagacacaaucacguacaacuguccccuucucaggcagaaugagccagaagacauagacuguuggugcaacuccacguccacauggguaacuuaugggacuuguacuaccacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcagcaauccuggcauauaccauagggacgacacauuuccagagagcccugauuuucaucuuacugacagcugucgcuccuucaaugacaaugcguugcauaggaauaucaaauagagacuuuguagaagggguuucaggaggaagcuggguugacauagucuuagaacauggaagcugcgugacgacgauggcaaaaaacaaaccaacauuggauuuugaacugauaaaaacagaagccaaacagccugccacccuaaggaaguacuguauagaggcaaagcuaaccaacacaacaacagaaucucgcugcccaacacaaggggaacccagccuaaaugaagagcaggacaaaagguucgucugcaaacacuccaugguagacagaggauggggaaauggauguggauuguuugggaagggaggcauugugaccugugcuauguuuacaugcaaaaagaacauggaaggaaaaguugugcaaccagaaaacuuggaauacaccauugugguaacaccucacucaggggaagagcaugcggucggaaaugacacaggaaaacauggcaaggaaaucaaaguaacaccgcagaguuccaucacagaagcagaauugacaggcuauggcacugucacgauggagugcucuccgagaacaggccucgacuucaaugagaugguguugcugcagauggaaaacaaagcuuggcuggugcacaggcaaugguuccuagaccugccguuaccauggcugcccggagcggauacacaagggucaaauuggauacagaaagaaacauuggucacuuucaaaaauccccaugcgaagaaacaggauguuguuguuuuaggaucccaagaaggggccaugcacacagcacucacaggggccacagaaauccaaaugucaucaggaaauuuacucuucacaggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccauguaaaaucccuuuugagauaauggauuuggaaaaaagacaugucuuaggucgccugaucacagucaacccaauugugacagaaaaagauagcccagucaacauagaagcagaaccuccauucggagacagcuacaucaucauaggaguagacccgggacaacugaagcucaacugguuuaagaaaggaaguucuaucggccaaauguuugagacaacaaugaggggggcgaagagaauggccauuuugggugacacagccugggauuuuggaucccugggaggaguguuuacaucuauaggaaaagcucuccaccaagucuuuggagcaaucuauggagccgccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuuguggaauccgcucaguaacaagacuggagaaucugauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggccccgaaacagcagaaugccccaacacaaauagagcuuggaauucguuggaaguugaagacuacggcuuuggaguauucaccaccaauauauggcuaaaauugaaagaaaaacaggaugcauucugcgacucaaaacucaugucagcggccauaaaagacaauagagccguccaugccgauauggguuauuggauagaaagugcacucaaugacacauggaagauagagaaagccucuuucauugaaguuaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaacuacagugguagugacugaggacugcggaaauagaggacccucuuugagaacaaccacugccucuggaaaacucauaacagaauggugcugccgaucuugcacauuaccaccgcuaagauacagaggugaggaugggugcugguacgggauggaaaucagaccauugaaagagaaagaagaaaauuugguuaacuccuuggucacagccggacaugggcagguugacaacuuuucacuaggagucuugggaauggcauuguuccuggaggaaaugcuuaggacccgaguaggaacgaaacaugcaauacuacuaguugcaguuucuuuugugacauugaucacagggaacauguccuuuagagaccuagggagaguggugguuaugguaggcgccacuaugacggaugacauagguaugggcgugacuuaucuugcccuacuagcagccuucaaagucagaccaacuuuugcagcuggacuacucuugagaaagcugaccuccaaggaauugaugaugacuacuauaggaauuguacuccucucccaaagcaccauaccagagaccauucuugaauugacugaugcguuagccuugggcaugaugguccucaaaaugguaagaaauauggaaaaguaucaauuagcagugacuaucauggcuaucuugugcgucccaaacgcagugauauuacaaaacgcauggaaagugaguugcacaauacuagcagugguguccguuuccccauugcuuuuaacauccucacagcaaaaaacggauuggauaccauuagcauugacaaucaagggucucaacccaacagcuauuuuucuaacaacccucucaagaaccagcaagaaaaggagcuggccauuaaaugaggcuaucauggcagucgggauggugagcauuuuagccaguucucuccuaaaaaaugauauucccaugacaggaccacuaguggcuggagggcuccucacugugugcuacgugcucacuggacgaucggccgauuuggaacuggagagagcagccgaugucaaaugggaagaccaggcagagauaucaggaagcaguccaauccugucaauaacaauaucagaagaugguagcaugucaauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccacccaugggaaaggcugaacuggaagauggagccuauagaaucaagcaaaaagggauucuuggauauucccagaucggagccggaguuuacaaagaaggaacauuccauacaauguggcaugucacacguggcgcuguccuaaugcacaaaggaaagaggauugaaccaucaugggcggacgucaagaaagaucuaauaucauauggaggaggcuggaaguuagaaggagaauggaaggaaggagaagaaguccagguauuggcauuggagccuggaaaaaauccaagagccguccaaacaaaaccuggucuuuucagaaccaacgccggaacaauaggugccguaucucuggacuuuucuccuggaacgucaggaucuccaaucauugacaaaaaaggaaaaguugugggucuuuaugguaaugguguuguuacaaggaguggagcauaugugagugcuauagcccagacagaaaaaagcauugaagacaacccagagaucgaagaugacauuuuccgaaagagaagacugaccaucauggaccuccauccaggagcgggaaagacgaaaagauaccuuccggccauagucagagaagcuauaaaacgggguuugagaacauuaaucuuggcucccacuagaguuguggcagcugaaauggaggaagcucuuagaggacuuccaauaagauaccaaaccccagccaucagagcugagcacaccgggcgggagauuguggaccuaaugugucaugccacauuuaccaugaggcugcuaucaccaguuagagugccaaacuacaaccugauuaucauggacgaagcccauuucacagacccagcaaguauagcagccagaggauacaucucaacucgaguggagaugggugaggcagcugggauuuucaugacagccacucccccgggaagcagagacccauuuccucagagcaaugcaccaaucauagaugaagaaagagaaaucccugaacguucguggaauucuggacaugagugggucacggauuucaaagggaagacuguuugguucguuccaaguauaaaagcaggaaaugauauagcagcuugccugagaaaaaauggaaagaaagugauacaacucaguaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucaucccuagcauguucgaaccagagcgugaaaaaguggaugccauugauggcgaauaccgcuugagaggagaagcaaggaaaaccuuuguagacuuaaugagaagaggagaccuaccagucugguuggccuacaaaguggcagcugaaggcaucaacuacgcagacagaaggugguguuuugauggaaucaagaacaaccaaaucuuggaagaaaacguggaaguugaaaucuggacaaaagaaggggaaaggaagaaauugaaacccagauggcuggaugcuaggaucuauucugacccacuggcgcuaaaagaauuuaaggaauuugcagccggaagaaagucucugacccugaaccuaaucacagaaauggguaggcuuccaaccuuuaugacucagaaggcaagagacgcacuggacaacuuagcagugcugcauacggcugaagcagguggaagggcguacaaucaugcucucagugaacugccggagacccuggagacauugcuuuuacugacacugcuggcuacagucacgggagggaucuuuuuauucuugaugagcgggaggggcauagggaagaugacccugggaaugugcugcauaaucacggcuagcauccuccuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauugggaagcauugcaacccagcaacccgagagcaacauccuggacauagaucuacguccugcaucagcauggacgcuguaugccguggccacaacauuuguuacaccaauguugagacauagcauugaaaauuccucagugaauguaucccuaacagcuauagccaaccaagccacaguguuaaugggucucgggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagggaagcucagaaaagagcagcggcgggcaucaugaaaaauccaaccgucgauggaauaacagugauugaccuagauccaauacccuaugauccaaaguuugaaaagcaguugggacaaguaaugcuccuaguccucugcgugacucaaguauugaugaugaggacuacaugggcucugugugaggcuuuaaccuuagcuaccgggcccaucuccacacugugggaaggaaauccaggaagauuuuggaacacuaccauugcggugucaauggcuaacauuuuuagagggaguuacuuggcuggagcuggacuucucuuuucuauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgagguucagcaaaacugagaugguucguugagagaaacauggucacaccagaagggaaaguaguggaccucgguuguggcagaggaggcuggucauacuauuguggaggacuaaaaaacguaagagaagucaaaggccuaacaaaaggaggaccaggacacgaagaacccauccccaugucaacauauggguggaaucuagugcgucuucaaaguggagucgacguuuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucagucauagaaaaaauggaaacacugcaaaggaaauauggaggagccuuagugaggaauccacucucacgaaacuccacacaugagauguacuggguaucuaaugcuuccgggaacauagugucaucagugaacaugauuucaaggauguugaucaacagauucacaaugagacacaagaaagccacuuacgagccggauguugaccucggaagcggaacccguaacaucgggauugaaagugagauaccaaaccuagauauaauugggaaaagaauagaaaaaauaaagcaagagcaugaaacaucauggcacuaugaccaagaccacccauacaaaacgugggcauaccaugguagcuaugaaacaaaacagacuggaucagcaucauccauggucaacggaguggucaggcugcugacaaaaccuugggacgucguccccauggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagacaguagguuuugggagcugguugacaaggaaaggaaucuccaucuugaaggaaagugugaaacauguguguacaacaugaugggaaaaagagagaagaagcuaggggaauucggcaaggcaaaagguagcagagccauaugguacauguggcuuggagcucgcuuccuagaguuugaagcccuaggauuccuaaaugaagaucacugguucuccagagagaacucccugaguggaguggaaggagaagggcugcacaagcuagguuacauucuaagagacgugagcaagaaagagggaggagcuauguaugccgaugacacagcaggaugggacacaagaaucacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacauuauaucgagaagagaccaaagagguaguggacaaguugguaccuauggacucaauacuuucaccaauauggaagcccaacuaaucagacagauggagggagaaggagucuucaaaaacauucagcaccugacagucacagaagaaaucgccgugcaaaacugguuggcaagaguggggcgcgaaagguuaucaagaauggccaucaguggagaugauuguguugugaaaccuuuagaugacagguucgcaagcgcuuuaacagcucuaaaugacaugggaaagauuaggaaagacauacaacaaugggaaccuucaagaggauggaacgauuggacacaagugcccuucuguucacaccauuuccaugagcuaaucaugaaagauggucgcguacuuguuguuccauguagaaaccaagaugaacugauuggcagagcccgaaucucccaaggagcaggguggucuuugcgggagacggccuguuuggggaaguccuacgcccaaauguggagcuugauguacuuccacagacgcgaccucaggcuggcggcaaaugccauuugcucggcaguaccaucacauuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccaccugggcaaagaacauccaagcagcaauaaaucaaguuagaucccuuauaggcaaugaggaauacacagauuacaugccauccaugaaaagauuuagaagagaagaggaagaagcaggaguccugugguag

SEQ ID NO: 7134 - RNA, 9876 nt, Artificial Sequence
  derived and/or modified CDS sequence (wt) from DENV-2__AY858036__SS-prME
acugcagguauaaucauuaugaugauuccaacagugauggcguuccauuuaaccacacgcaacggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccgcaugugggaaugggacuggagacacgaacugaaacauggaugucaucagaaggggccuggaaacaugcgcagagaauugaaacuugggucuugagacauccaggcuucaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaagacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaaaggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacaaaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuuuaaaaauccccaugcaaagaaacaggauguuguuguuuuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauagucaucagaguacaauaugaaggggacgguucuccaugcaagaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagagccgggacaacugaagcucagcugguuuaagaaaggaaguucuauuggccaaauguuugagacaacaaugagaggagcgaagagaauggccauuuuaggugacacagcuugggauuuuggaucccugggaggaguguuuacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggaguagugacauuguauuugggaguuauggugcaggccgauagugguugcguugugaguuggaaaaacaaagaacugaaauguggcagugggauuuuugucacagacaacgugcacacguggacagaacaauacaaauuccagccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggaccauggcaucuaggcaggcuugagauggacuuugauuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggauguugguauggaauggaaaucagaccauugaaagagaaagaagagaacuuggucaacucuuuggucacagccggacauggacagauugacaacuucucacuaggagucuugggaauggcauuguuccuggaagagaugcucaggacccgagugggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccgacuuuugcagcuggacuacucuuaaggaagcugaccuccaaggaauugaugaugaccaccauaggaauuguacuccucucucagagcaccauaccagagacuauacuugaacugacugacgcguuggcuuuagggaugaugguucucaaaauaguaagaaacauggaaaaguaucaacuagcagugaccaucauggcuaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucgcaagaacuagcaagaaaaggagcuggccacuaaaugaggcuauuauggcagucgggauggugagcauuuuagccaguucucucuuaaaaaaugauauucccaugacaggaccauuaguggcuggagggcuucucacuguguguuacgugcucacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggagugcugugggaugucccuucaccuccaccugugggaaaagccgaacuggaagauggagccuauagaaucaagcagaaagggauucuaggauacucgcagaucggagcuggaguuuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagcggaacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugacucugaauauaucaagacuaggaccaaugauugggacuuuguggucacgacagacauuucagaaaugggugccaacuucaaggcugagaggguuauagaccccagacgcugcaugaaaccagucauacuaacagacggugaagaacgggugaucuuggcaggacccaugccagugacccacucuagugcagcacaaagaagagggagaguuggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugauggugaauaccgcuugagaggagaagcgaggaaaacauuuguggaccuaaugagaagaggagaccuaccagucuggcuagccuacagaguggcagcugaagguauuaacuacgcagacagaagguggugcuuugauggagucaagaacaaccaaauccuggaagaaaauguggaaguggaaauuuggacaaaagaaggagaaaggaagaaauuaaaacccagaugguuggaugcuaggaucuacucugacccacuagcgcucaaagaauucaaggaauucgcagcuggaagaaaaucccugaccuugaaucuaaucaccgagauggguaggcucccaaccuucaugacccagaaagcaaggaaugcauuggacaacuuagcaguccugcauacggcugaaacaggcggaagggcguacaaucaugcucuuagugaacugccggagacucuggagacauugcuuuuacugacacuuuuggccacagucacgggcggaaucuuccuguucuugaugagcggaaaagguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccucacagugguggccgcaaccauggcaaaugagauggguuuccuagaaaaaacaaagaaagauuucggauugggaagcauuacaacccagcaaccugagagcaacauccuggacauagaucuacguccugcaucagcuuggacucuauaugccguggcaacaacuuucaucacaccaauguugagacacagcauugaaaauuccucagugaaugugucucuaacagccauugccaaccaggccacaguguuaaugggccuugggaaaggauggccauugucaaaaauggacaucggaguuccccuucucgcuaucggaugcuauucacaagucaaccccauaacucucacagcagcccuucucuuauugguagcacauuaugcuaucauagggccaggacuccaggcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguacugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagagacgcucggagagaaauggaaaaaccgguugaaugcauuggggaagagugaauuccagaucuauaagaaaaguggaauccaggaaguggauagaaccuuagcaaaagaaggcaucaaaagaggagagacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagagcccauucccaugucaacauaugguuggaaucuggugcgucuucaaaguggaguugaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagacguugaucucggaaguggaacccgcaacaucggaauugaaagugagacaccaaauuuagacauaauuggaaaaagaauagaaaaaauaaaacaagagcaugaaacaucauggcacuaugaccaagaccacccauacaaaacgugggccuaccauggcagcuaugaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaagguacgaaaaaacuaaugaaaaucacggcagaauggcucuggaaagaacuaggaaagaaaaagacaccuaggaugugcaccagagaagaauucacaagaaaggugagaagcaaugcagccuuaggugccauauuuacugaugagaacaaguggaagucggcacgugaggcuguugaagacagugaauuuugggaauugguugacaaggaaaggaaucuccaucuugaaggaaagugugagacauguguguauaacaugaugggaaagagagagaagaaguuaggggaguucggcaaagcaaaaggcagcagagccauaugguacauguggcuuggagcacgcuucuuagaguuugaagcccuaggauuuuugaaugaagaucacugguuuuccagagagaacucccugaguggaguggaaggagaagggcugcacaaacuaggcuacauuuuaagagacgugaguaagaaagaaggaggagcaauguacgccgaugacacugcaggaugggacacaagaaucacacuagaggacuuaaaaaaugaagaaauggugacaaaccacauggaaggagaacauaagaaacuugcugaagccauuuucagauuaacguaccaaaacaagguggugcgugugcaaagaccgacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaccugacaguuacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucuagaggauggaacgauuggacacaagugcccuuuuguucacaccauuuccaugaguuaaucaugaaggacggucguguacuuguaguuccauguagaaaccaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaauccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7135 - RNA, 9876 nt, Artificial Sequence
  derived and/or modified CDS sequence (wt) from DENV-2__HQ332184__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggaaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacaggcugggacuuuggaucccugggaggaguguucacaucuauaggaaaggcucuccaccaaguuuucggagcaaucuauggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuaggcaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaacacugcuaguugcagcaucuuuuguaacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccauuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuccucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 7136 - RNA, 9876 nt, Artificial Sequence
  derived and/or modified CDS sequence (wt) from DENV-2__HQ332185__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaauuaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagacuuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaaaacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagccgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaaguugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 7137 - RNA, 9876 nt, Artificial Sequence
  derived and/or modified CDS sequence (wt) from DENV-2__HQ332186__SS-prME
acagcaggcgugaucguuauguugauuccaacagcgauggcguuccauuuaaccacacgcaauggagaaccacacaugaucguuggcaggcaggagaaagggaaaagucuucuguucaaaacagaggaugguguuaacauguguacccucauggccauagaccuuggugaauugugugaagacacaaucacguacaaguguccucuccucagacaaaaugaaccagaggacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcaaaaaacaaaccaacauuggauuuugaacugauaaaaacagaagccaaacaaccugccacucugaggaaguacuguauagaagcaaagcugaccaacacaacgacagaaucgcguugcccaacacaaggggagcccagccuaaaugaagagcaggacaaaagguucaucugcaaacacuccaugguagacagaggauggggaaauggauguggauuauuuggaaagggaggcauugugaccugugcuauguucacaugcaaaaagaauauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagacuugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaagcuccaucggccagauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugaggugaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccucuuucauugaaguuaaaagcugccacuggccaaagucacacaccuucuggagcaauggaguauuagaaagugagaugauaauuccaaaaaauuuugccgggccagugucacaacacaacuacagaccagguuaccauacacaaauagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccccuaagauacagaggugaggauggaugcugguacgggauggaaaucagaccauugaaagagaaagaggagaauuuggucaacucuuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagcuaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcagggaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaacgaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguauaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagagaaacagagaacaccccaagacaaccaauugaccuacguugucauagccauccucacagugguggccgcaaccauggcaaaugagauggguuuccuggaaaaaaccaagaaagaccucggauugggaagcaucacaacccaggaaccugagagcaacauccuagacauagaucuacgcccugcaucagcauggacgcuguaugccguggcuacaacauuugucacaccaauguugagacauagcauugaaaauuccucagugaaugucucucuaacagccauugcuaaccaagcuacagugcuaaugggucuugggaaaggauggccauugucaaagauggacaucggaguuccccuccuugccauuggaugcuacucacaagucaacccuauaacucuuacagcagcucuucuuuuauugguagcacauuaugccauuauagggccaggacuccaagcaaaagcaaccagagaagcucagaaaagagcagcagcaggcaucaugaaaaacccaacaguugauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggccuaucuccacacugugggaaggaaauccagggagguuuuggaacacuaccauugcagugucaauggcuaacaucuuuagagggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuccagaucuacaagaaaaguggaauccaggaaguagauagaacccuagcaaaagaaggcaucaaaagaggagaaacggaccaccaugcugugucgcgagguucagcaaaacugagaugguucgucgagagaaacauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaauuccacgcaugaaauguacuggguaucuaaugccaccggaaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacacauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacguaggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagagguacaguaauggauaucauaucgagaagagaccaaagaggcagugggcaagucggcaccuauggccucaauaccuucacuaauauggaagcccaauuaauuagacagauggagggagaaggaaucuucaaaagcauucagcaccugacagucacagaagaaaucgcuguacagaacugguuagcaagaguggggcgugaaaggcuaucaagaauggcaaucaguggggaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccacuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 7138 - RNA, 9876 nt, Artificial Sequence
  derived and/or modified CDS sequence (wt) from DENV-2__HQ332187__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugauccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagucauagucagagaagccauaaaacguggcuugagaacauuaauucuggcucccacuagagucguggcagcugaaauggaggaagcccuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaaguugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuggggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacguaggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 7139 - RNA, 9876 nt, Artificial Sequence
  derived and/or modified CDS sequence (wt) from DENV-2__HQ332188__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaggacauagauuguuggugcaacucuacguccacauggguaacuuacgggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcaaaaaacaaaccaacauuggauuuugaacugauaaaaacagaagccaaacaaccugccacucugaggaaguacuguauagaagcaaaguugaccaacacaacgacagaaucgcguugcccaacacaaggggaacccagccuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagacuugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccagauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugaggugaaguugaccauuaugacaggagacacuaaaggagucaugcaggcaggaaaacgauccuugcggccccagcccacugagcugaaguacucauggaaaacauggggaaaggcgaaaaugcucuccacagagucucacaaucagaccuuucuuauugauggcccugaaacaacagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaauagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccccuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagcgacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaauccaaguccuggcauuggaaccuggaaaaaaucccagagccguccaaacaaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagcuaucaaagccgagcauaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaagcagguggaagggcguauaaucaugcucucagugaacugccggaaacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagagaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaccugagagcaacauccuagacauagaucuacgcccugcaucagcauggacgcuguaugccguggcuacaacauuugucacaccaauguugagacauagcauugaaaauuccucagugaaugucucucuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacaguugauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuggcgaccgggccuaucuccacacugugggaaggaaauccagggagguuuuggaacacuaccauugcagugucaauggcuaacaucuuuagagggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugcgggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaauuccacgcaugaaauguacuggguaucuaaugccaccggaaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggauaucauaucgagaagagaccaaagaggcagugggcaagucggcaccuauggccucaauaccuucaccaauauggaagcccaauuaauuagacagauggagggagaaggaaucuucaaaagcauucagcaccugacagucacagaagaaaucgcuguacagaacugguuagcaagaguggggcgugaaaggcuaucaagaauggcaaucaguggggaugauuguguuguaaaaccuauagaugacagauuugcaagugcuuuaacagcucuaaaugacaugggaaaaguuaggaaagauauacaacaaugggaacccucaagaggauggaaugauuggacacaagugccuuucuguucacaccacuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugcuauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauaccugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 7140 - RNA, 9876 nt, Artificial Sequence
  derived and/or modified CDS sequence (wt) from DENV-2__HQ332189__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaacuggaucuugagacauccaggcuuuaccauaauggcagcaaucuuggcauacaccauaggaacgacacauuuccaaagggccuugauuuucaucuuacugacagcugucgcuccuucaaugacaaugcgcugcauaggaauaucaaauagagacuucguggaagggguuucaggagggaguuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauuuggagacagcuacgucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuacggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagcgagaugauaauuccaaaaaauuuugccgggccagugucacaacacaacuacagaccagguuaccauacacaaacagcaggaccuuggcaccuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucaccgccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacuccugagaaaacugaccuccaaggaauuaaugauggccaccauaggaaucacacuccuuucccaaaguaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaauuuagugcgucugcaaagcggaguugacguuuucuucaccccgccagaaaagugugauacauuguugugugacauaggggagucgucaccaagucccacgauagaagcaggacgaacacucagaguccucaacuuaguggaagauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugagacaucauggcacuaugaucaagaccacacauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaauuagccgaggccauauucaaauuaacguaccaaaacaagguggugcgugugcaaagaccaacgccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaaguccuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauaccugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 7141 - RNA, 9876 nt, Artificial Sequence
  derived and/or modified CDS sequence (wt) from DENV-2__JN368476__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacauacaaguguccucugcucaggcagaaugagccagaggacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccugagacauccaggcuucaccauaauggcagcaaucuuggcauacaccauagggacgacacauuuccagagagcccugauuuucauucuauugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacaggggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaguaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggagcaaagagaauggccauuuugggugacacagccugggacuuuggcucccuaggaggaguguuuacaucuauaggaaaagcucuccaccaagucuuuggagcaaucuauggagcugccuucagugggguuucauggacuaugaaaauccucauaggagucauuauuacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauaggccaggcuaccacacacaaacagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcaccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggccucaauccaacagccaucuuucuaacaacccucucaagaaccaacaagaaaaggagcuggccacuaaaugaggccaucauggcagucggaauggugagcauucuagccaguucccuccugaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccgauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucgacacgaguggagaugggugaggcagcugggauuuucaugacagccacucccccgggaaguagagauccauuuccucagagcaaugcaccaaucauagaugaagaaagagaaaucccugagcguucauggaauacuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaacccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaaccuagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcggaaggggcauagggaagaugacccugggaaugugcugcauaaucacggcuagcguccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcugaggcauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaacugucgauggaauaacagugauugaucuagauccaauaccuuaugauccaaaguuugaaaagcaguugggacagguaaugcuacuaauccucugcgugacucaaguauugaugaugaggacuacaugggcucugugugaggccuugaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaacuaacacaagaaggggaacuggcaacauaggagagacgcuuggagagaaauggaaaagccgauugaaugcacugggaaaaagugaauuccagaccuacaagaaaaguggaauccaagaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauacggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagagaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 7142 - RNA, 9876 nt, Artificial Sequence
  derived and/or modified CDS sequence (wt) from DENV-2__JF260983__SS-prME
acagcgggcuuccuuaucauggucauuccaacagugauggcuuuccauuugaccacacgcaacggggagccacacaugauugucagcaagaaugagaaaggaaagggccuccuuuuuaaaacagagaauggaauaaacaugugcacccuuauggccauggacuuaggcgaguugugugaggacaccgucacauacaagugccccuuccucaagcaaaacgagccggaggauauagacugcuggugcaauuccacaucaaccugggugacguacgggacgugcagcucgacaggagagcauaggagggagaaaaggucagucgcacuugucccacauguaggaauggggcuggaaacgagaacugaaacauggaugucaucagaaggagcauggaaacaagcccagcggauugagacauggauucugaggcacccaggcuucacucuuauggcagcugucuuggcguacacaauagggacaacacauuuccaaagagcccuaaucuuuauccuuuuaacagcuguugcucccucgaugacaaugcgauguauaggcauaucaaaucgagacuucguggagggaguuucaggaggaagcuggguugauaucgucuuagaacacggaagcugcgucacaacaauggccaagaacaaaccaacauuagacuuugaacuaauaaaaacagaggccaagcaaccagcaacauugagaaaauucugcauagaagccaaauugaccaacacaacaacagaaucucgcugcccaacccaaggugaacccagccuaguagaggagcaggacaaaagauucgucugcaggcauucaaugguggauagaggcugggguaauggauguggucuguuugggaaaggagguauugugaccugugcgauguucacaugcuugaagaaaauggagggaaaaguugugcagccagaaaaccuagaguacaccauagucauaacaccccauucaggagaggaacaugcuguggggaaugauacagggaagcacgguaaggagguuaagauaacaccucaaagcucuauuucugaaacugaacugacagauuauggcacgaucacgauggaaugcuccccacgaacaggucucgauuuuaaugagaugguccugcugcagauggagagcaaagcuuggcuaguccauagacagugguuucuggacuuaccucuaccauggcuuccuggagcagacacacaaggguccaauuggauccagaaagagaugcuaguaacauucaaaaauccccaugcgaaaagacaggacguugucgucuuaggaucacaagagggcgcuaugcacacagcacucacaggagcaacagaaauucaaaugucauuaggaaauauacuauucauggggcauuugaaguguagacugaggauggacaagcugcaacucaaagggaugucauacuccauguguacaggaaaguuuaaaguugucaaagagauagcggaaacacaacauggaacgauagucaucagagugcaguaugaaggagaugacucaccauguaagauucccuuugagaucauggacuuggaaaagaaacauguuuuagggcgacugaucacggucaacccaauagugacagagaaagacaguccaaucaacauagaagcagaaccuccauucggugauagcuacauugucauaggaguggagccaggacagcugaaauuaaacugguuuaaaaagggaagcucuauaggacaaauguuugaaacaacaaugagaggagcuaaaagaauggccaucuugggagacacagcuugggauuuuggauccauagggggaguguucacaucaguaggaaaagcacuacaucaaguuuuuggcgcaaucuauggcgccgccuuuagcgggguuucauggaccaugaagauccucauaggggugguuauaacauggauaggaaugaacucccgcagcacuuccuugucagugacccugguguuaguaggaaucgugacacuauaccugggagugauggugcaagcggacagugguugcguuguaagcuggaagaacaaagaacugaaauguggaaguggaaucuuugugacugacaaugugcacacuuggacggaacaauacaaauuucaaccagacuccccuucaaaguuggcuucugcaauucaaaaagcccaugaggaaggaaucuguggaauccguucaguuacaagguuggaaaaucuaauguggaagcagauaacaccagaauugaaccacauccuaucugaaaaugaagucaaacugaccaucaugacaggagagauuaaggggauuaugcaagcagggagaagaucuuugaaaccccaacccacugagcugagauacucauggaaaacuuggggaaaagcgaagguacuaucaacagaacuucaaaaucagacuuuccucauagacgguccugaaacaacugaaugcccuaacagcaauagagccuggaacucuuuggaaguugaggauuauggcuuugggauuuuuaccaccaauauauggcuaaaguugagagagaaacaagacaugauuugugauucaaaguugaugucagcagcugucaaggacgacagagcaguucaugcugauaugggcuauuggauagagagcagacugaaugacacauggaagauggaaaaagcaucauuuauugagguuaaaagcugcuacuggccaagaucacacacccuuuggagcaauggagugcuggagagugaaaugauaauuccaaagaaucuggcuggaccagugucgcagcacaacuacagaccaggcuauuacacacaaacagccggaccauggcauuugggcaaacucgagauggauuucgaguuuugugaaggaaccacgguaguggugaccgaggauugcggaaacagaggaccaucccugagaacaaccacugccucaggaaaacucauaacugaguggugcugcagaucaugcacauuaccaccacuaagauacagaggagaggauggaugcugguacggaauggaaauuagaccacugaaagaaagagaagagaaccuggugaacucauugguuacagccggacauggccaaauugacaauuucucacuagggauuuugggaauggcauugcucuuggaagagaugcuuagaaccagaguaggaacaaagcacgccuugcugcuaguggcgaucuccuucgugacacugauuacagggaacauguccuucaaggaucuaggaagagugauaauuauggugggagcagccaugacggacgagauggguaugggcgugacauacuuggcauuacuagcugcuuucagagucagacccaccuuugcagugggguugcuuuuaagaaaacucacuucaaaggaauuguugauggcaaccaucggagucguucuccucucucagagcaacauaccaggaacaguuuuggaauugaccgaugcaauagcauugggaauaaugguucuuaaaauaaugaggagcauggaaaaauaccagcuagcagugaccgucauggcuaugcuauguauuccaaaugucaugauacuccagcaugcauggaaaguagguugcaccauauuggcagcagucucuguaucaccacuccuccugacuuccucacaacaaaaaacggacuggauaccguuagcccucacaauaaaaggucucaauccaacugcuauuuucuuaacaacucugucuagacccaguaaaauaagaaguuggccucuuaaugaagccaucauggcaguuggaauggugagcauauuagcuaguucccucuugaaaaaugacauuccaaugacgggaccacugguggcaggaggacuucucacagugugcuaugugcuuacuggcagaucggcagacuuggagcuagaaaaagcggcagaggugaaaugggaagaucaagcugagauauccgggaguagcccaauccuaucaaucacuauaucagaagaugguaguaugucaauaaagaaugaggaagaagagcagacucuaaccauacugauaaggacaggacuguuaguaauaucaggacuauucccaguaucaaucccaaucacagccgcggccugguaccuaugggagacaaaaaagcagagggccggagugcugugggacguuccuucaccuccaccaaugggaaaagcugagcuagaagauggcgcuuacaggaucaaacagagagggauuuucggauacucucaaauuggggccggaguguauaaagaagguacauuucacacgauguggcacgucacacguggagccguccuagugcacaaagggaaaagacuugagccaucaugggcagacgugaagaaagacuugauaucauauggaggaggcuggaaacuggaaggagaguggaaagauggcgaagagguucagguuuuagcgcuggaacccggaaaaaacccgagagcagugcaaacaaaacccggccucuucaaaaccaacacaggaacaauaggagccguuuccuuagacuuuuccccaggaacaucaggauccccaaucauugacaggaaaggaaaagucgugggucucuacggaaauggugucgugacaagaagcggaaccuaugugagcuccauagcccaaacagagaaaaguguagaggacaauccagagauugaagaugauauauuucggaagaaaagguuaaccaucauggacuuacauccaggagcggggaaaacaaaacgauaucucccagccauaguuagagaagcaauaagaagaggccugagaacacugauucuagcccccacuagaguaguggcugcagaaauggaggaagcccuacgggggcucccaauccguuaccagacuccggccauuaaggcagagcacacugggcgcgaaaucguagaccuaaugugucaugccacauucacuaugagguuauugucaccaauuaggguaccaaacuacaaccuaaucauaauggaugaagcccauuucacagacccagcuagcauagcagcccgaggauacaucuccacccguguagaaaugggagaagcugcuggaauauuuaugacagccacuccuccaggcaguagggacccuuuuccacagagcaacgccccaauaauggacgaggaaagagagaucccugaacgcucauggaauuccggacaugaauggauaacaaacuucaaagguaaaacaguaugguuugucccaagcauaagagcuggaaacgacauagcagccugcuuaagaaaaaaugggaaaagagugauucagcuaaguaggaaaaccuuugacacagaauacaccaaaacaagaacaaacgacugggacuucguagucacgacugacaucucggaaaugggggcaaacuucaaagcugaaagagugauagauccaaggagaugcaugaagccaguuauauugacagauggugaagagcgcgugguucuggcaggaccuaugccaguuacucacucaagugcagcacagagaagagggagaauaggaaggaauccaaaaaaugagaacgaccaauauauuuacaugggagaaccuuuagagaaugaugaagacugugcucacuggaaggaggcaaagaugcuccuugauaacaucaacacaccugaagguaucauccccagcauguucgagccagaacgugagaaaguugaugccauagacggugaauaccgguuaaggggggaagcaagaaaaaccuuuguagaccugaugaaaagaggagaccuaccaguuuggcuggcuuacaagguagcuucggaaggcauaaacuaugcagacaggaaguggugcuuugauggaaucagaaacaaucagauccuagaggagaacauugaaguggaaguuuggacgaaagaaggugagaggaaaaaacuaaaacccagauggcuggacgcaagaacuuauucagauccgcuagcacucaaagaguucaaggaauuugcggccggaaggaagucucuaaccuugaguuugaucacagaaaugggccggcucccaaccuucaugacccaaaagacaagagaugcccuggacaacuuggcuguguugcacuccgcagaaauggguggaagagccuauaaccaugcucucagugaacugccagaaacucuagaaacauuacucuugcuaggucuucuggccacagucacagggggaaucuuuuuguucuugaugaguggaagagguguagggaaaaugacucucggaauguguugcauaaucacggccagcggccuucugugguaugcacagauacagccccauuggauugcagcuucaauaauauuggaguucuuucucauaguacugcuaaucccugaaccagaaaagcaaagaacaccacaggacaaccaguugaccuauguggucauagccaucuugacacuaguggcagccaccauggcaaacgaaauggguuuucuagaaaagacaaagaaagaccuuggguugggaggcuucacaaugcaacaaccagaaauaaacauuuuggacauagaccuccgaccugcaucagcguggacgcuauaugcaguggccacuacguuugucacgccaaugcugaggcacagcauagaaaacuccucagugaaugugucacuaacagcuauagcaaaucaggccacggugcuuaugggcuugggaaaagguuggccacuaucaaaaauggacauaggaguuccucuucuugccauugggugcuacucgcaggugaaucccauaacccucacagcagcacuacugcuauugguggcacacuacgccaucauagguccuggacuccaagcaaaggcuaccagagaggcgcagaaaagagcagcagccggcaucaugaagaauccaacaguagaugggaucacagugauugaccuagaaccaauacccuaugauccgaaguuugagaagcagcuagggcaagugaugcuuuuaguccuuugugugacacagguguugaugaugagaaccacgugggcucuaugcgaagcccuaacccuagcaacagggcccauaucaacacugugggaaggaaauccaggaaaauuuuggaacacaacaauagcaguuucuauggcuaauaucuucagagggaguuauuuggcuggagcuggacuccuuuucuccaucaugaggaacacaaccagcgcacgaagaggaaccggcacuauaggugaaacuuuaggagaaaaauggaagagucggcuaaaugcacugggaagaagugaauuccaaauauacaagaaaagugggauucaggaaguagacagaacccuggcgaaggaaggcauaaaaagaggagaaacagaccaccaugccguuucacggggcucugcaaagcugagaugguuuguugaaagaaacaugguugccccggagggaaagguaguagaccuugguuguggcagaggaggauggucauauuacugugguggacuaaaaaaugugagagaagucaaaggccugacuaaaggaggaccaggacaugaggagccuauaccuaugucaacauacggguggaaucuagugcgacugcagaguggaguggauguauucuuuacuccaccagagagaugcgacacacugcuaugcgacauaggagaaucaucaccaaaccccacaguggaggccggacgaacacugagaguucucaaucuaguagaaaauugguugggaagcaacacacaguuuugcauaaaaguccuuaacccuuacaugccaucagucauagagagaauggaaacauuacagagaaaguuuggaggcgcucuaguccgcaauccacuuucaaggaauuccacgcacgagauguacuggguguccaacgcuucuggaaacauuguaucuucugugaacaugauuucaaggauguugauaaauagauucacaaugaggcacaagaaagccaccuacgagccugacguugaucuuggaaguggaacacgcaacaucggaauugagugugaaacgccaaacauggacauaauuggaaaacggauugagaaaauaaaacaagaacaugaagcgucauggcacuaugaccaagaucauccauacaaaacaugggcauaccacggcaguuaugagacgaaacaaacaggaucagcaucaucaaugguaaacggagugguuaggcuauugacaaaacccugggaugucauucccauggugacgcaaauggcaaugacagacacaacccccuuuggacagcagcguguuuucaaggaaaaaguagauacaagaacccaggaaccaaaagagggcacgaaaaaauugaugagaaucacagcagaguggcuuuggggugaguuaggaaggagaaagaagccuagaaucugcacaagagcagaguucuguaauaaagugagaagcaacgcagcucugggggccguguucacugaugagaacaaguggaagucagcacgcgaagcggucgaagaugaaagauuuugggagcugguggaaaaagagagaaaccuucaccucgacggaaagugugaaacauguguguacaacaugaugggaaaaagagagaagaaacuuggagaauuuggcaaagcaaaaggcagcagagccauaugguauauguggcuaggugcccgcuuucuagaguuugaggcccuagguuuuuugaacgaagaccauugguucucuagagaaaauucucuaaguggaguggaaggagaaggacugcacaagcugggcuacauccuaagagacaucagcaggaaagcaggaggagcaauguaugcagaugacacugcugguugggacacaaggaucacaucugaggaucugaagaaugaagaaaugauaacagaccaaauggaagggagacauaagaagcuggcagaggccauauucagacuaacauaucagaauaagguaguucgcguccaaagaccaaccccaagaggcacggugauggacaucauuucaaggagagaccaaagaggcagugggcagguggggacguacggucucaacaccuucaccaauauggaagcacaacugauaaggcagauggaaggggaaggacucuuuaagagcauacugcacuuaacaccccaagaggaaacugcuguccacgcuuggcuaguuagagagggacgcgaacgccucgcaagaauggcaaucaguggagaugacugcgucgugaaaccacuagaugacagauucgccagagcucuaacagcauugaaugacaugggaaaagugaggaaagacauacaacagugggaacccucaaaaggauggagugauuggacccaagugcccuuuugcucucaccacuuucaugaacuaauaaugaaagauggucgcaagcuuguagucccaugcagaaaccaggaugaacugauaggcagagcgcgcaucucccagggggcaggaugguccuugagagagacagccuguuuggggaagucauaugcccagauguggagccugauguacuuccacaggcgugaucucagguuggcugcaaaugccauauguucagcaguuccaucacauuggguuccaacuagcaggacgacuugguccauacaugcuagucaugaauggaugacgacggaagacaugcuagcagucuggaacaggguguggauccaggacaacccauggauggaagacaagacccccguggaaucaugggaagacauaccauaucuagggaaaagggaggaucaguggugugguucccugauuggauuaacaagcagggccacuugggcaaagaacauucaaacagccauaaaccaggucagagcucucauuggugaggaggaauacauggacuacaugcccucaaugaaaagguucagaagugaagaggaggaaucaggaguccugugguaa

SEQ ID NO: 7143 - RNA, 9876 nt, Artificial Sequence
  derived and/or modified CDS sequence (wt) from DENV-2__AF119661__SS-prME
acaguaggcgugauuauuauguugauuccaacagcgauggcguuccauuuaaccacacguaauggagaaccacacaugaucguugguagacaagagaaagggaaaagucuucuguucaaaacagaggauggugugaacauguguacccucauggccauagaucuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaucauaauggcagcaauccuggcauacaccauaggaacgacacauuuccaaagggcccugauuuucaucuuacugacagcugucgcuccuucaaugacaaugcguugcauaggaguaucaaauagagacuuuguagaagggguuucaggaggaagcuggguugacauagucuuagaacauggaaguugugugacgacgauggcaaaaaacaaaccaacauuggauuuugaacugauaaaaacagaagccaaacaaccugucacucuaaggaaguacuguauaaaagcaaagcugaccaauacaacaacagaaucucguugcccaacacaaggggaacccagucuaaaugaagagcaggacaaaagguucgucugcaaacacuccaugguagacaggggauggggaaauggauguggauuauuuggaaagggaggcauugugaccugugcuacguuuacaugcaaaaagaacauggaaggaaaaaucgugcaaccagaaaauuuggaauacaccaucgugauaacaccucacucaggagaagagcacgcuguagguaaugacacaggaaaacaugguaaggaaaucaaaauaacaccacagaguuccaucacagaagcagaacugacaggcuauggcaccgucacgauggagugcucuccgagaacgggccuugacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaacccgaucguaacagaaaaagauagcccagucaacauagaagcagaaccuccauucggagacagcuacaucaucauaggaguagagccgggacaauugaaacucaacuggguuaagaaaggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugccuuuaguggggucucauggacuaugaaaauccucauaggagucaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggauuuucaucacagauaacgugcacacauggacagaacaauacaaguuccaaccagaauccccuucaaaacuagcuucagcuauccaaaaagcucaugaagaaggcauuuguggaauccgcucaguaacaagacuggagaaucugauguggaaacaaauaacaccagaauugaaucacauucuaucagaaaaugaggugaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguuuugugacucaaaacucaugucagcagccauaaaagacaacagagccguccaugccgauauggguuauuggauagaaagugcacucaaugacacauggaagauggagaaggccucuuucauugaaguuaaaagcugccacuggccaaagucacacacccucuggaguaauggaguauuagaaagugagaugauaauuccaaaaaguuuugcugggccagugucacaacacaacuacagaccaggcuauuacacgcagacagcaggaccuuggcaucuagguaagcuugagauggacuuugauuucugcgaaggaacuacagugguggugacugaggacugcggaaauagaggacccucuuuaagaacgaccacugccucuggaaaacucauaacagaauggugcugccgauccugcacauuaccaccgcuaagauacagaggugaggauggaugcugguaugggauggaaaucagaccauugaaagagaaagaagagaguuuggucgacuccuuggucacagccggacaugggcagauugacaacuuuucacuaggagucuugggaauggcacuauuccuggaagaaaugcucaggacacgaguaggaacgaaacaugcaauacugcuaguugcaguuucuuuugugacauugauuacugggaacaugucccuuagagaccugggaagagugaugguuauggugggcgcuaccaugacggaugacauagguaugggagugacuuaucuugcccuacuagcagcuuucaaaguuagaccaacuuuugcagcuggacuacuacugagaaaguugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagcuauuuuucuaacaacucuugcgagaaccagcaagaaaaggagcuggccgcuaaaugaggcuaucauggcagucgggauggugagcauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggacucuuuccagugucaauaccaauuacggcagcagcaugguaccugugggaagugaagaaacaacgggcuggaguauugugggacgucccuucacccccacccguggaaaaggccgaacuggaagauggagccuauagaaucaagcaaaaagggauucuuggauauucccagauuggaaccggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcauuggaaccuggaaaaaauccaagagcuguccaaacgaaaccuggacuuuucaaaaccaacaccggaaccauaggcgccguaucucuggacuuuuccccuggaacgucaggaucuccaauugucgacagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaauauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaacucuggacaugaaugggucacggauuuuaaagggaagacuguuugguuuguuccaaguauaaaagcgggaaaugacauagcagcuugucucagaaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucugguuggccuacagaguggcagcugaaggcaucaacuacgcagacagaaggugguguuuugauggaguuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaguccuugacccugaaccuaaucacagaaauggguaggcuuccaacuuucaugacucagaaggcaagagacgcacuggauaaccuagcugugcugcauacggcugaggcagguggaagggcguacaaucaugcucucagugaacugccggagacccuggagacacugcuuuuacugacacuccuggcuacagucacgggaggaauuuucuuauucuuaaugagcggaaaagguguagggaagaugacccugggaaugugcugcauaaucacggcuaguauccuccuaugguaugcacagauacaaccacacuggauagcagcuucaauaauauuggaguuuuuucucaugguuuugcucauuccagaaccagaaaaacagagaacaccccaagauaaccaauugaccuacguugucauagccauccucacagugguggccgcaaccauggcaaacgagauggguuuccuggaaaaaaccaagaaagaucucggauugggaagcauugcaacccaagaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggaugcuacucacaagucaaccccauaacucucacagcagcucuucuuuugcugguagcacauuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacaguuaggacaaguaaugcuccuaauucucugcgugacucaaguauuaaugaugaggacuacaugggcucugugugaggcucuaaccuuagcgaccgggcccaucuccacauugugggaggguaauccagggagguuuuggaacacuaccauugcagugucaauggcuaacaucuuuagagggagcuacuuggccggagcuggacuucucuuuuucaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaacccauccccaugucaacauauggguggaaucuaguacgucugcagaguggaguugauguuuucuucacuccgccagaaaagugugauacauuguugugugacauaggggagucgucaccaaaucccacgauagaagcaggacgaacacucagaguccucagcuugguggaaaauugguugaacaaugacacccaauuuugcauaaagguucucaacccauauaugcccucaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauaauagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccuaggauucuugaaugaagaucacugguucuccagagagaacucccugaguggaguggaaggagaagggcugcacaagcuaggcuacauuuuaagagacgugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauauuuaaauuaacguaccaaaacaaggcggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccuguuuggggaaguccuacgcccaaauguggagccugauguacuuccacagacgugaccucaggcuggcggcaaaugcuauuugcucggcagucccgucacauuggguuccaacaagucgaacaaccuggucuauacacgccaaacaugaauggaugacgacggaagacaugcugacagucuggaacaggguguggauccaagaaaacccauggauggaagacaaaacuccaguggagucaugggaggaagucccauacuugggaaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7144 - RNA, 9876 nt, Artificial Sequence
  derived and/or modified CDS sequence (wt) from DENV-2__EU056810__SS-prME
acugcaggcauaauuaucauguugauuccaacagugauggcguuccauuugaccacacgcaacggagaaccacacaugaucgucaguagacaagagaaagggaaaagucuucuguuuaaaacagaggauggugugaacauguguacccucauggccauggaucuuggugaauugugugaagacacaaucacuuauaauuguccucuucuuaggcagaaugaaccagaagauauagacuguuggugcaacuccacguccacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuuggaucuugagacauccaggcuuuaccauaauggcagcaaucuuggcauacaccauaggaacgacauauuuucaaagaguccugauuuucaucuugcugacagcugucgcuccuucaaugacaaugcguuguauaggaauaucaaauagagacuuuguggaagggguuucaggaggaagcuggguugacauagucuuagagcauggaagcugugugacgacgauggcaaaaaauaaaccgacauuggauuuugaacugauaaaaacagaagccaaacaacccgcuacucuaaggaaguauuguauagaggcaaagcugaccaacacaacaacagcaucucgcugcccaacacaaggggaacccagccuaaaugaagagcaggacaaaagguucgucugcaaacauuccaugguagacagaggauggggaaauggaugcggauuauuuggaaagggaggcaucgugacuugugcuauguucacaugcaaaaagaacauggaaggaaaagucgugcaaccagaaaacuuggaauacaccauugugauaacaccucacucaggggaagagaaugcagucggaaaugacacaggaaaacacggcaaggaaaucaaaauaacaccacagaguuccaucacagaagcagaacugacaggcuauggcacugucacgauggagugcucuccuagaacgggccucgacuucaaugagaugguguugcugcaaauggaaaacaaagcuuggcuggugcacagacaaugguucuuagaccugccguuaccauggcugcccggagcggacacacaaggaucaaauuggauacaaaaggagacauuggucacuuucaaaaauccucaugcgaagaaacaggauguuguugucuuaggaucccaagaaggggcuaugcauacagcacuuacaggggccacggaaauccagaugucaucaggaaacuuacuguucacaggacaccucaagugcaggcugagaauggacaaacuacagcucaaaggaaugucauauucuauguguacaggaaaguuuaaaguugugaaggaaauagcagaaacacaacauggaacaauaguugucagaguacaauaugaaggggacgguucuccaugcaagauucccuuugagauaauggauuuggaaaaaagacaugucuuaggucgcuugauuacagucaacccaauuguuacagaaaaagacagcccagucaacauagaagcagaaccuccauucggagacagcuacaucauuauaggaguagaaccgggacaacugaagcucaacugguucaagaaaggaaguucuaucggccaaauguuugagacaacaaugagaggagcgaagagaauggccauuuuaggugacacagccugggauuucggaucccugggaggaguguucacaucuauaggaaaggcucuccaccaaguuuuuggagcaauuuauggggcugccuucaguggggucucauggacuaugaaaauccucauaggaguugucauuacauggauaggaaugaauucacgcagcaccucacugucugugucacuaguauuagugggagucgugacauuguauuugggaguuauggugcaggccgauagugguugcguugugaguuggaaaaacaaagaacugaaauguggcagugggauuuuugucacagacaacguacacacauggacagaacaauacaaauuccaaccagaaucuccuucaaagcuggcuucagcuauccagaaagcucaugaagaaggcaucuguggaauccgcucaguaacaagacuggagaaucugauguggaaacaaauaacaccagaacugaaucacauuuuaucagaaaaugagguaaaguugacuaucaugacaggagacauuaaaggaaucaugcaggcaggaaaacgauccuugcggccucagcccacugagcugaaguauucauggaaaacuuggggcaaagcgaaaaugcucucuacagagcuucauaaccagaccuuucucauugauggccccgaaacagcagaaugucccaacacaaacagagcuuggaacucacuagaaguugaagacuauggcuuuggaguauucaccaccaacauauggcuaaaauugaaagaaaggcaggauguauuuugugacucaaaacucaugucagcggccauaaaagacaacagagccguccaugccgauauggguuauuggauagaaagcgcacucaaugacacauggaagauagagaaagccucuuuuaucgaaguuaaaagcugccacuggccgaagucacauacucucuggaguaauggagugcuagaaagcgagaugauaauuccaaagaauuuugcuggaccagugucacaacacaacuacagaccaggcuaucacacacaaacggcaggacccuggcaucuagguaagcuugagguggacuuuaauuucugcgaagggacuacagugguggugaccggggacugugggaauagaggacccucuuuaagaacaacuaccgccucuggaaaacucauaacagaauggugcugccgaucuugcacauuaccaccgcuaagauacagaggugaggauggauguugguacgggauggaaaucagaccauugaaagagaaagaagagaacuuggucaacucuuuggucacagccggacauggacagauugauaacuucucacuaggagucuuaggaauggcauuguuccuggaagaaaugcucaggacccgaguaggaacaaaacaugcaauauuacuaguugcaguuucuuuugugacauugaucacagggaacauguccuuucgagaccuggggagagugaugguuauggugggugccacuaugacggaugauauaggcaugggcgugacuuaucuugcccuacuagcagccuucaaaguuagaccaacuuuugcagcuggacuacucuugagaaagcugaccuccaaggaauugaugaugaccaccauaggaaucguacuccucucucagagcaccauaccagagacuguacuugaacugacugaugcacuggcucuggggaugaugguccucaaaauagugagaaauauggaaaaguaucaauuagcagugacuaucauggcuaucuugugcgucccaaaugcagugauauuacaaaacgcauggaaagugaguugcacaauacuggcagugguguccgucucaccacugcucuuaacauccucacagcagaaagcggauuggauaccauuggcauugacgaucaaaggccucaauccaacagccauuuucuuaacaacccuuucaagaacuagcaagaaaaggagcuggccacuaaaugaggcuaucauggcagucgggauggugagcauuuuagcuaguucucucuuaaagaaugacauccccaugacaggaccacuaguggcuggagggcuucucacaguguguuacgugcucacuggaagaucggccgauuuggaacuggagagggccgcugacgugagaugggaagaucaggcagagauaucaggaagcaguccaauucugucaauaacaauaucggaagaugguagcaugucgauaaaaaaugaagaggaagaacaaacacugaccauacucauuagaacaggacuguuggugauaucaggacuuuuucccguaucaauaccaaucacggcagcagcaugguaccugugggaagugaagaaacaacgggcuggaguauugugggaugucccuucacccccacccgugggaaaggccgaacuggaagauggagcuuauagaaucaagcagaaagggauucuuggauacucccagaucggagccggaguuuacaaagaaggaacauuccacacgauguggcacguuacacguggugcuguucuaaugcauaaagggaagagaauugaaccaucaugggcggacgucaagaaagaccuaauaucguauggaggaggcuggaagcuagaaggagaauggaaggaaggagaagaaguccaggucuuggcauuagagccuggaaagaauccaagagccguccaaacaaaacccggccuuuucaaaacuaacaccggaaccauaggcgccgugucucuggacuuuucuccuggaacgucaggaucuccaaucgucgacaaaaaaggaaaagucgugggucuuuauggcaauggugucgucacaaggaguggaacauaugugagugcuauagcccagacugaaaaaagcauugaagacaauccagagauugaagaugacaucuuucgaaagaaaagauugaccauuauggaccuccacccaggagcgggaaagacgaagagauaccuuccagcaauagucagagaggcuauaaaacgaggcuugagaacauuaauccuggcccccacuagagucguggcagcugaaauggaggaagcucuuagaggacuuccaauaagauaccaaaccccagccaucagagcugagcacacugggcgggagauuguggaucuaaugugccacgccacauuuaccaugaggcugcuaucaccaguuagagugccaaauuacaaccugaucaucauggacgaagcccauuuuacagacccagcaagcauagcagcuagaggauacauuucaacucgaguagagaugggugaagcagcugggauuuucaugacagccacuccuccgggaagcagagacccauuuccucagagcaaugcaccaauuauggaugaagaaagggaaaucccugaacgcucguggaauucuggacaugagugggucacggacuuuaaagggaagacuguuugguuuguuccaaguaucaaagcaggaaaugauauagcagcuugccugagaaaaaauggaaagaaagugauacaacucaguagaaagaccuuugauucugaauauaucaagacuaggaccaaugauugggacuucguggucacgacugacauuucagaaaugggugccaacuucaaggcugagaggguuauagaccccagacgcugcaugaaaccagucauacuaacagacggcgaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugugcacauuggaaagaagcuaagaugcuucuagauaacaucaacacgccugaaggaaucauucccagcauguucgaaccagagcgugaaaagguggaugccauugauggugaauaccgcuuaagaggagaagcgaggaaaaccuuuguggaccuaaugagaagaggagaccuaccagucuggcuggccuacagaguggcagcugaagguaucaacuacgcagacagaaggugguguuuugauggaaucaagaacaaccaaaucuuagaagaaaauguggaaguggaaauuuggacaaaagaaggggaaaggaagaaauuaaaacccagaugguuggaugcuaggaucuauucugacccgcuggcacucaaagaauucaaggaauucgcagcuggaagaaagucccugacccugaaucuaaucacagagauggguaggcuuccaacuuucaugacucagaaagcaaggaacgcacuggacaacuuagcaguccugcauacggcugaagcaggcggaagggcauacaaucaugcucuuagugaacugccggagacccuggagacauugcuuuuacugacacuuuuggcuacagucacgggcggaaucuuucuauucuugaugagcggaaaagguauagggaaaaugacccugggaaugugcugcauaaucacggccaguauucuccuaugguacgcacaaauacaaccacacuggauagcagcuucaauaauacuggaguuuuuucucauagucuugcuuauuccagaaccagaaaagcagagaacaccccaagacaaccaauuaacuuacguuguuauagccauccucacggugguagcugcaaccauggcaaacgagauggguuuccuggaaaaaacgaagaaagauuucggauugggaagcauugcaacccagcaacccgagagcaacauccuggacauagaucuacguccugcaucagcguggacucuguaugccguggccacaacauucaucacaccaauguugagacauagcauugaaaauucuucagugaauguuucccuaacagcuauugccaaccaagccacaguguuaaugggucuugggaaaggauggccauugucaaaaauggacaucggaguuccccuucucgccauugggugcuauucacaagucaaccccauaacucucacagcagcccuucuuuuauugguagcacauuaugcuaucauagggccaggacuccaagcgaaagcaaccagagaagcucagaaaagagcagcagcgggcaucaugaaaaacccaacuguagauggaauaacagugauugaccuagauccaauacccuaugauccaaaguuugagaagcaguugggacaaguaaugcuccuaguccucugcgugacucaaguauugaugaugaggacuacaugggcuuugugugaggcucuaacccuagcgaccgggcccaucuccacauugugggaaggaaauccagggagauuuuggaauacaacuauugcagugucaauggcuaacauuuuuagagggaguuacuuggccggagcuggacuccucuuuucuaucaugaagaauacagccaacacaagaaggggaacuggcaacacaggagagacgcuuggagagaaauggaaaaaccgauugaaugcauuggggaagagugaauuccagaucuauaagaaaaguggaauucaggaaguggacagaaccuuagcaaaagaaggcauuaaaagaggagaaacggaccaucacgcugugucgcgaggcucagcaaaacugagaugguucgucgagagaaaccuggucacaccagaggggaaaguaguggaccucgguugcggcagaggggguuggucauacuauugugggggacuaaagaauguaagagaagucaaaggccuaacaaaaggaggaccaggacacgaagaacccauucccaugucaacauauggguggaaucuggugcgucuucagaguggagucgauguuuuuuuuacuccgccagaaaagugugacacauugcugugugacauaggggaaucgucaccaaaucccacgauugaagcaggacgaacacucagagucuuaaacuuaguggaaaauuggcugaacaacaacacccaauuuuguauaaagguucucaacccauacaugcccucaguuauagaaaaaauggaagcgcuacaaaggaaauacggaggagcuuugguaaggaauccacucucacgaaauuccacacaugagauguacuggguuuccaaugcuuccgggaacauagugucaucagugaacaugauuucaaggauguugauuaacagauuuacaaugagacauaagaaggccacauacgagccagauguugaccucggaagcggaacccgcaacaucggaauugaaagugagacaccaaacuuagacauaauuggaaaaagaauagaaaaaauaaaacaagagcaugaaacaucauggcacuaugaccaagaccacccauacaaaacgugggccuaccauggcagcuacgaaacaaaacagaccggaucagcaucauccauggugaacggaguaguuagauugcugacaaaaccuugggacgucaucccuacggugacacagauggcaaugacagacacgacuccauuuggacaacagcgcguuuucaaagagaaaguggacacgagaacccaagaaccgaaagaaggcacgaagaaacuaaugaaaaucacggcagaauggcucuggaaagaacugggaaagaaaaagacaccuaggaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugaaacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaagcuaggcuacauuuuaagagaugugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggauauuauaucgagaagagaccaaagagguaguggacaaguuggcaccuauggucucaacacuuucaccaauauggaagcccaacuaaucaggcagauggagggagaaggagucuucaaaagcauccagcacuugacagucacagaagaaauuacagugaaaaacuggcuagcaagaguggggcgugagagguuaucaagaauggccaucaguggagaugauuguguugugaaaccuuuagaugacagguuugcaagcgcucuaacagcucuaaaugacaugggaaagguuaggaaagacauacaacaaugggaaccuucaagaggauggaacgacuggacacaagugccuuuuuguucacaccacuuccaugaguuaaucaugaaagacggucguguacucguaguuccauguagaaaccaagaugaacugauugguagagcccgaauuucacagggagccggguggucuuugcgggagacggccuguuuggggaagucuuacgcccaaauguggagccugauguacuuccacagacgugaccucaggcuggcggcaaaugcuauuugcucggcagucccaucacauuggguuccaacaagucgaacaaccugguccauacacgccagacaugaguggaugacaacggaagacaugcugacagucuggaacaggguguggauucaagaaaacccauggauggaagacaaaacuccaguggaaucaugggaggaaaucccauaccuggggaaaagagaagaccaauggugcggcucauugauugggcuaacaagcagggccaccugggcaaagaacauccaaacagcaauaaaucagguuagaucccuaauaggcaaugaggaauacacagacuacaugccauccaugaaaagauucagaagagaagaggaagaggcaggagucuugugguag

SEQ ID NO: 7145 - RNA, 9876 nt, Artificial Sequence
  derived and/or modified CDS sequence (wt) from DENV-2__EU056811__SS-prME
acugcaggcaugaucaucaugcugauuccaacagugauggcguuucaucugaccacacgcaacggagaaccacacaugaucgucaguagacaagaaaaagggaaaagccuucuguuuaagacaaaggauggcacgaacaugugcacucuuauggccauggaccuuggugaguugugugaagacacaaucacguauaaguguccuuuucucaagcagaacgaaccagaagacauagauuguuggugcaacuccacguccacauggguaacuuacgggacauguaccaccacaggagagcacagaagagaaaaaagaucaguggcgcuuguuccacacgugggaaugggauuggagacacgaacugaaacauggaugucaucagaaggggccuggaaacaugcccagagaauugaaacuuggauucugagacauccagguuuuaccauaauggccgcaauccuggcauacacuauaggaacgacgcauuuccaaagaguccugauauucauccuacugacagccaucgcuccuucaaugacaaugcgcugcauaggaauaucaaauagggacuuuguggaaggagugucaggagggaguuggguugacauaguuuuagaacauggaaguugugugacgacgauggcaaaaaauaaaccaacauuggacuuugaacugauaaaaacagaagccaaacaacccgccaccuuaaggaaguacuguauagaggccaaacugaccaacacgacaacagacucgcguugcccaacacaaggggaacccacccugaaugaagagcaggacaaaagguuugucugcaaacauuccaugguagacagaggauggggaaauggauguggauuguuuggaaaaggaggcaucgugaccugugcuauguucacaugcaaaaagaacauggaaggaaaaauugugcagccagaaaaccuggaauacacugucgugauaacaccucacucaggggaagaacaugcagucggaaaugacacaggaaaacaugguaaagaagucaagauaacaccacagagcuccaucacagaggcggaacugacaggcuauggcacuguaacgauggagugcucuccaagaacgggccucgacuucaaugagaugguguugcugcaaauggaagacaaagcuuggcuggugcacagacaaugguuccuagaccuaccguugccauggcugcccggagcggacacacaaggaucaaauuggauacagaaagagacauuggucaccuucaaaaauccccaugcgaaaaaacaggauguuguuguccuaggaucccaagagggggccaugcauacagcacucacaggggccacggaaauccaaaugucaucaggaaaccugcuguucacaggacaucucaaaugcaggcugagaauggacaaauuacaacuuaaagggaugucauacuccaugugcacaggaaaauuuaagauugugaaggaaauagcagaaacacaacauggaacaauagucauuagaguacaauaugaaggagacggcucuccaugcaagauccccuuugagauaauggaucuagaaaaaagacauguuuugggccgccugaucacagucaauccaauuguaacagaaaaggacaguccagucaacauagaagcagaaccuccauucggagacagcuacaucaucauaggaguagaaccaggacaauuaaagcuggacugguucaagaaaggaaguuccaucggucaaauguuugagacaacaaugaggggagcgaaaagaauggccaucuugggcgauacagccugggauuuuggaucucugggaggaguguuuacaucaauaggaaaagcucuccaccagguuuucggagcaaucuacggggcugcauucagugggguuucauggacuaugaagauccucauaggaguuaucaucacauggauaggaaugaacucacgcagcacaucacugucugugucacugguauuagugggaaucgugacacuguacuugggaguuauggugcaagccgauagugguugcguugugagcuggaagaacaaagaacuaaaauguggcaguggaauauucgucacagauaacgugcauacauggacagaacaauacaaguuccaaccagaauccccuucaaaacuggcuucagccauucagaaagcucacgaagaaggcaucuguggaauccgcucaguaacaagacuggaaaaucuuauguggaaacagauaacaucagaauugaaucauauucuaucagaaaaugaagugaaacugaccaucaugacaggagacaucaaaggaaucaugcagguaggaaaacgaucucugcggccucaaccuacugaguugagguauucauggaaaacaugggguaaagcgaaaaugcucuccacagaacuccacaaucagaccuuccucauugauggucccgaaacagcagaaugccccaacacaaacagagcuuggaauucacuagaaguugaggacuauggcuuuggaguauucacuaccaauauauggcuaagauugagagaaaagcaagaugcauuuugugacucaaagcucaugucagcggccauaaaggacaacagagccguccaugcugauauggguuauuggauagaaagcgcacucaaugauacauggaagauagagaaagcuucuuucauugaagucaaaaguugccacuggccaaagucacacacucuauggaguaauggagugcuagaaagcgagaugguaauuccaaagaauaucgcuggaccagugucacaacauaauaacagaccaggcuaucacacacaaacagcaggaccuuggcaucuaggcaagcuugagauggacuuugauuucugcgaagggaccacaguggugguaaccgaagaauguggaaacagagggccuucuuuaagaacaaccacugccucaggaaaacucauaacggaaugguguugucgaucuugcacacuaccaccauuaagauacagaggugaggauggaugcugguacgggauggaaaucagaccauugaaagagaaagaagaaaaucuggucagcucccuggucacagccggacaugggcagauugauaauuucucauuaggaaucuugggaauggcgcuguuccuugaagaaaugcucaggacucgaguaggaacgaaacaugcaauacuacuaguugcaguuucuuuccuaacguuaaucacagggaacaugucuuuuagagaccugggaagagugaugguuauggugggugccaccaugacagaugacauaggcaugggugugacuuaucuugcccuacuagcagccuucaaagucagaccaaccuuugcagcuggacugcucuugagaaaacugaccuccaaggaauugaugaugaccaccauaggaaucguucuccucucccagaguaguauaccagagacuauucuugagcugaccgaugcguuagccuuaggcaugaugguccucaagauggugagaaacauggaaaaauaucagcuggcagugacuaucauggcuauuuugugugucccaaaugcugugauauuacagaacgcauggaaagugaguugcacaacacuggcaguggugucuguuuccccccugcucuugacauccucacagcagaaagcggacuggauaccuuuagcguugacgaucaaaggccugaaucccacagccauuuuucuaacaacccucacaagaaccagcaagaaaaggagcuggccuuuaaacgaggccaucauggcgguugggauggugaguaucuuggccagcucucucuugaagaacgacauccccaugacaggaccauuaguggcuggagggcuucucacugugugcuacguauuaaccgggcggucagccgaucuggaacuagagagagcuaccgaugucaaaugggaugaucaggcagagauaucagguagcaguccaauucugucaauaacaauaucagaagauggcagcaugucaauaaagaaugaagaggaagagcaaacacugacuauacucauuagaacaggacugcuugugaucucaggacucuuuccgguaucaauaccaauuacagcagcagcaugguaccugugggaaguaaagaaacaacgggcuggaguguugugggauguccccucaccaccacccgugggaagggcugaauuggaagauggagccuacagaaucaagcaaaaaggaauucuuggauauucccagaucggagcuggaguuuacaaagaaggaacauuucacaccauguggcacgucacacguggcgcaguccuaaugcauaaggggaagaggauugaaccaucaugggcggacgucaagaaagacuuaauaucauauggaggagguuggaagcuagaaggagaauggaaagaaggagaagaaguccaggucuuggcauuggagccugggaaaaauccaagagccguccaaacaaaaccuggccuuuuuagaaccaauacuggaaccauaggcgccguaucucuggacuuuuccccugggacgucaggaucuccaaucguugacaaaaaaggaaaaguuguaggucucuauggcaacgguguuguuacaagggguggagcauaugugagugccauagcucagacugaaaaaggcauugaagacaauccagagauugaagaugacaucuuucgaaagagaagauugacuaucauggaucuccacccaggagcaggaaagacaaagagauaccucccggccauaguuagagaggccauaaaaagaggcuugagaacacuaauccuagcccccacuagagucguggcagcugaaauggaggaagcccuuagaggacuuccaauaagauaccaaacuccagcuauuagggcugagcacacagggcgggagaucguggacuuaaugugucacgccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaauuuuuaugacagccacuccuccgggcagcagagauccauuuccucagaguaaugcaccaauuauggacgaagaaagagaaauuccggaacguucauggaacuccgggcacgagugggucacagauuuuaaaggaaagacugucugguuuguuccaagcauaaaaaccggaaaugacauagcagccugucugagaaagaauggaaagagggugauacaacucaguaggaagaccuuugauucugaauacgucaagacuagaaccaaugacugggauuucgugguuacaacugacauuucggaaaugggugccaacuuuaaagcugagaggguuauagaccccagacgcugcaugaaaccagucauacugacagacggcgaagagcgggugauucuagcaggacccaugccagugacccacuccagugcagcacaaagaagagggagaauaggaaggaauccaaggaaugaaaaugaucaauacauauauaugggagaaccccuggaaaaugaugaagacugugcgcacuggaaggaagcuaagaugcuccuagauaacaucaacacaccugaaggaaucauucccagcauguucgagccagagcgugaaaagguggaugccauugacggugaauaucgcuugagaggagaagcacggaaaacuuuuguggaccuaaugagaagaggagaccuaccagucugguuggcuuauaaaguggcagcugaagguaucaacuacgcagacagaagaugguguuuugacggaaccagaaauaaucaaaucuuggaagaaaauguggaaguggaaaucuggacaaaggaaggggaaaggaaaaaauugaaaccuagaugguuagaugcuaggaucuacuccgacccacuggcgcuaaaagaauucaaggaauucgcagccggaagaaaguccuuaacccugaaccuaaucacagagaugggcagacucccaacuuuuaugacucagaaggccagagaugcacuagacaacuuagcggugcugcacacggcugaagcggguggaaaagcauacaaucaugcccucagugaacuaccggagacccuggagacacugcuuuugcugacacuguuggccacagucacgggaggaaucuuucuauuccugaugagcggaagggguauagggaagaugacccugggaaugugcugcauaaucacggccagcauacucuuaugguaugcacaaauacaaccacauuggauagcagcuucaauaauauuggaguucuuucucauaguauugcucaucccagaaccagaaaagcagaggacaccccaggauaaucaauugacuuaugucauuauagccauccucacagugguggccgcaaccauggcaaacgaaauggguuuucuagaaaaaacaaagaaagaccucggacugggacacauugcaacucagcaaccugagagcaacauucuggauauagaucuacguccugcaucagcauggacguuguaugccguggcaacaacauuuaucacaccaauguugagacauagcauugaaaauuccucaguaaaugugucccuaacagccauagcuaaccaggccacagugcuaaugggucucggaaaaggauggccauugucaaagauggacauuggaguuccccuccuugccauuggguguuacucacaagucaaccccauaacucucacagcggcucuucuuauguuaguagcacauuaugccaucauaggaccgggacuucaagccaaagcaaccagagaagcucagaaaagggcagcggcgggcaucaugaaaaacccaacuguggauggaauaacagugauagaucuagauccaauacccuaugauccaaaguuugaaaagcaguugggacaaguaaugcuccuaguccuuugugugacccaagugcugaugaugaggacuacgugggcuuugugugaagccuuaacucuagcaaccggacccguguccacauugugggaaggaaauccagggagauucuggaacacaaccauugcagugucaauggcaaacaucuuuagagggaguuaccuugcuggagcuggacuucucuuuucuaucaugaagaacacaacuagcacgagaagaggaacuggcaacaugggagaaacgcuaggagagaaauggaaaaacagacugaacgcauuggggaaaagugaauuccagaucuacaaaaaaaguggaauucaagaaguggacagaaccuuagcaaaagaaggcauuaaaagaggagaaacggaucaucacgcugugucgcgaggcucagcaaaacugagaugguucguugaaagaaauuuggucacaccagaagggaaaguaguggaccuugguugcggcagagggggcuggucauacuauuguggagguuugaagaauguaagagaaguuaaaggcuuaacaaaaggaggaccaggacacgaagaaccuaucccuaugucaacauauggguggaaucuaguacgcuuacagagcggaguugauguuuuuuuuguuccaccagagaagugugacacauuguugugugacauaggagaaucaucaccaaaucccacgguagaggcgggacgaacacucagaguccuuaaccuaguggaaaauuggcugaacaauaacacccaauuuugcguaaagguucuuaacccauacaugcccucagucauugaaaggauggaaaccuuacaacggaaauacggaggagcccuggugaggaauccacucucacggaauuccacacaugaaauguacuggguguccaaugcuuccgggaacauagugucaucagugaacaugauuucaagaaugcugauuaacagauucaccaugagacacaagaaggccaccuaugagccagaugucgaccucggaagcggaacccgcaacauuggaauugaaagugagacaccgaaccuagacauaauugggaaaagaauagaaaaaauaaaacaggagcaugaaacgucauggcacuaugaccaagaccauccauacaaaacaugggcuuaccaugguagcuaugaaacaaaacagacgggaucagcaucauccauggugaacggaguagucagacugcugacaaagcccugggacguuauuccaauggugacacagauggcaaugacagacacaacuccuuucggacaacagcgugucuucaaagagaagguggauacgagaacucaagaaccaaaagaaggcacaaaaaaacuaaugaaaaucacagcagaauggcucuggaaagaacuaggaaagaaaaagacaccuagaaugugcaccagagaagaauucacaaaaaagguaagaagcaaugcagccuugggggccauauuuaccgaugagaacaaguggaagucggcgcgugaggcuguugaagacaauagguuuugggagcugguugacaaggaaagaaaccuccaucuugaaggaaaaugugaaacauguguauacaacaugaugggaaaaagagagaaaaaacuaggagaguuugguaaagcaaaaggcagcagagccauaugguacauguggcucggagcacgcuucuuagaguuugaagcccuaggauuuuugaaugaagaccauugguucuccagagagaacucccugaguggaguggaaggagaagggcugcauaaacuagguuacaucuuaagagaggugagcaagaaagaaggaggagcaauguaugccgaugauaccgcaggcugggacacaagaaucacaauagaggauuuaaaaaaugaagaaaugauaacgaaccacauggcaggagaacacaagaaacuugccgaggccauuuucaaauugacguaccaaaacaagguggugcgugugcaaagaccaacaccaagaggcacgguaauggacaucauaucgagaagagaccaaagggguaguggacaaguugucaccuauggccucaacacuuucaccaacauggaagcgcaacuaauuaggcaaauggagggggaaggagucuucaaaagcauccagcacuugacagccucagaagaaaucgcugugcaagauuggcuaguaagaguagggcgugaaaggcugucaagaauggccaucaguggagaugauuguguugugaaaccuuuagaugacagauuugcaaaagcucuaacagcucuaaaugacaugggaaagguuaggaaggauauacagcaaugggagcccucaagaggauggaacgacuggacacaggugcccuucugcucacaccauuuucacgaguuaaucaugaaagauggccgcacacuuguaguuccaugcagaaaucaagaugaauugaucggcagagcccgaauuucccagggagcuggguggucuuuacgggagacggccuguuugggaaagucuuacgcccaaauguggagccugauguacuuccauagacgugaucucagguuagcggcaaaugccauuugcucggcagucccgucacacuggguuccaacaagccggacaaccugguccauacacgccagccaugaauggaugacgacggaagacauguugacaguuuggaacagaguguggauccuagaaaauccauggauggaagacaaaacuccaguggaaucaugggaggaaaucccauaccugggaaaaagagaagaccaauggugcggcucacugauugggcugacaagcagagccaccugggcgaagaauauccagacagcaauaaaccaagucagaucccucauuggcaaugaggaauacacagauuacaugccauccaugaaaagauuuagaagggaagaggaagaggcaggaguuuugugguag

SEQ ID NO: 7146 - RNA, 9876 nt, Artificial Sequence
  derived and/or modified CDS sequence (wt) from DENV-2__DQ645545__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucacaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacaggaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucgagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7147 - RNA, 9876 nt, Artificial Sequence
  derived and/or modified CDS sequence (wt) from DENV-2__DQ645546__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7148 - RNA, 9876 nt, Artificial Sequence
  derived and/or modified CDS sequence (wt) from DENV-2__DQ645547__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacgccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaauaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcggguaauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagagggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccuaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7149 - RNA, 9876 nt, Artificial Sequence
  derived and/or modified CDS sequence (wt) from DENV-2__DQ645549__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagcuauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagugaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7150 - RNA, 9876 nt, Artificial Sequence
  derived and/or modified CDS sequence (wt) from DENV-2__DQ645550__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggaguccugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagaguaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagacuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagagggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacauuggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagugaaaguggacacgagaacccaagaaccuaaagaaggcacgaaaaaacuaaugaaaaucacggcagaauggcucuggaaagaauuaggaaagaaaaagacaccuagaaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7151 - RNA, 9876 nt, Artificial Sequence
  derived and/or modified CDS sequence (wt) from DENV-2__DQ645551__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccacaauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaacuauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacauuaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacacagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7152 - RNA, 9876 nt, Artificial Sequence
  derived and/or modified CDS sequence (wt) from DENV-2__DQ645552__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccauccugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugacauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugaguggaaaaggcauagggaagaugacccugggaaugugcugcauaaucacggccaguguucuccugugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugauaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaucaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7153 - RNA, 9876 nt, Artificial Sequence
  derived and/or modified CDS sequence (wt) from DENV-2__DQ645553__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaaguuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggauccccgggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucucuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaaaaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuucguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcuggcagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7154 - RNA, 9876 nt, Artificial Sequence
  derived and/or modified CDS sequence (wt) from DENV-2__DQ645554__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaauccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggaguguuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccauccugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaauuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7155 - RNA, 9876 nt, Artificial Sequence
  derived and/or modified CDS sequence (wt) from DENV-2__DQ645555__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucacaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacugaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggacauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggcuaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagccuuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcuuuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7156 - RNA, 9876 nt, Artificial Sequence
  derived and/or modified CDS sequence (wt) from DENV-2__DQ645556__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucacacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacuagaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggcuacagucacgggcggaaucuuccuauucuugaugagcggaaaaggcauagggaagaugaccuugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggauauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggccaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagagggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggauacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaaacauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacguacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7157 - RNA, 9876 nt, Artificial Sequence
  derived and/or modified CDS sequence (wt) from DENV-2__AF204178__SS-prME
acugcaggcaugaucauuaugcugauuccaacagugauggcguuccauuuaaccacacguaacggagaaccacacaugaucgucagcagacaagagaaagggaaaagucuucuguuuaaaacaggggauggugugaacauguguacccucauggccauggacccuggugaauugugugaagauacaaucacguacaaguguccucuucucaagcagaaugaaccagaagacauagauugguggugcaacucuacguccacauggguaacuuaugggacguguaccacuacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccaugauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagauucucgcugcccaacacaaggagaacccagccuaaaugaagagcaggacaaaagguucgucugcaaacacuccaugguggacagaggauggggaaauggauguggauuauuuggaaaaggaggcauugugaccuuugcuauguucacaugcaaaaagaacaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgaugaagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaauguuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacgacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggucauaaaagacaacagagccgcccaugccgauauggguuauuggauagaaagugcacucaaugacacauggaagauagagaaagccucuuucaucgaaguuaaaagcugccacuggccaaagucacacacccucuggaguaauggagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaggucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucauaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaauacugaccauacucauuagaacaggauugcuggugaucucaggacuuuuuccuguaucaauaccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaaaaaauuaaaacccagaugguuggaugccaagaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcucuuacugacacuucuggcuacagucacgggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaggcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaauccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaaacacuacaaaggaaauauggaggagccuuaguggggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcuguacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguacggcgcgaaagguuaucaagaauggcuaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucagacuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 7158 - RNA, 9876 nt, Artificial Sequence
  derived and/or modified CDS sequence (wt) from DENV-2__AF204177__SS-prME
acugcaggcaugaucauuaugcugauuccaacagugauggcguuccauuuaaccacacguaacggagaaccacacaugaucgucaguagacaagagaaagggaaaagucuucuguuuaaaacaggggauggugugaacauguguacccucauggccauggaccuuggugaauugugugaagauacaaucacguacaaguguccucuucucaggcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggaucuugaacugauaaaaacagaagccaaacaaucugccacucuaaggaaguacuguauagaggcaaaguugaccaacacaacaacagaaucucgcugcccaacacaaggagaacccagccuaaaugaagagcaggacaaaagguucgucugcaaacacuccaugguggacagaggauggggaaauggauguggauuauuuggaaaaggaggcauugugaccugugcuauguucacaugcaaaaagaacaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugaaaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaauguuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccuccuucaucgaaguuaaaagcugccacuggccaaagucacacacccucuggaguaaugaagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauguugcugccgauccugcacauuaccaccgcuaagauacagaggugaggacggaugcugguacgggauggaaaucagaccauugaaagagaaagaagagaacuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauagggaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaaaaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaauacugaccauacucauuagaacaggauugcuggugaucucaggacuuuuuccuguaucaauaccaaucacggcagcagcaugguaccugugggaagugaagaaacaacgggcuggaguauugugggaugucccuucacccccaccggugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauaugcaggaggcuggaagcuagaaggagaauggaaggaaggagaagaaguccaggucuuggcacuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaaaagaaaauugaccaucauggaccuccacccaggagcgggaaagacgaagagauaccuuccggccauagucagagaggcuauaaaacggggccugaggacauugauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuggauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucuggcuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacgggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccaacaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaagaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacuuucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacauuauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaagcggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggaguuuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaacccucaagaggauggaacgauuggacacaagugcccuucuguucacaccauuuccaugaguuaaucaugaaagacggccgcguacuuguaguuccaugcagaaaccaaaaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuucaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 7159 - RNA, 9876 nt, Artificial Sequence
  derived and/or modified CDS sequence (wt) from DENV-2__DQ645540__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaauuacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugacaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguugacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacaguuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucauacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggacauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggcuaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagauaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagugaaaguggacacgagaacccaagaaccuaaagaaggcacuaaaaaacuaaugaaaaucacggcagaauggcucuggaaagaauuaggaaagaaaaagacaccuaggaugugcaccagagaagaauucacaagaaaggugaggagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7160 - RNA, 9876 nt, Artificial Sequence
  derived and/or modified CDS sequence (wt) from DENV-2__DQ645541__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugacaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacaguuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucauacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggacauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggcuaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaaguggaacccgcaacaucggaauugaaagugagacaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7161 - RNA, 9876 nt, Artificial Sequence
  derived and/or modified CDS sequence (wt) from DENV-2__DQ645542__SS-prME
acugcagguguaaucauuaugaugauuccaacagugguggcguuccauuuaaccacacgcaacggagaaccacacaugaucgucaguagacaagagaaagggaaaagucuucuguuuaaaacagagaacggugugaacaugugcacccuuauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugacaaaaacggaagccaaacauccagccacuuuaaggaaguauuguauagaggcaaagcugaccaacacaacaacagcaucucgcugcccaacacaaggagaacccagccuaaaugaagaacaggacaaaagguuugucugcaaacacuccaugguugacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaagguaacaccacagaguuccauuacagaagcagaacugacagguuauggcaccgucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacaguuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuuuagcgggguuucauggacuaugaaaauccucauaggaguugucaucacauggauaggaaugaauucacgcagcaccucacugucugugucacuaguauuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcaugggguaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaacugaaagaaaggcaggauguauuuugugacucaaaacucaugucagcagccauaaaggacaacagggccguccacgccgauauggguuauuggauagaaagcgcacuuaaugacacauggaagauugagaaagccucuuucauugaaguuaaaagcugccauuggccaaagucacacacucucuggaguaauggagugcuagaaagugagaugauaauuccaaagaauuuugcaggaccagugucacagcacaacuacagaccaggcuaucauacacaaacggcaggacccuggcaccuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaacuuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuuuucgagauuuggggagagugauggucauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacaucaucacagcagaaagcagauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagcuaguucccucuugaagaaugauauucccaugacaggaccauuaguagcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuaggacaggacugcuggugauaucaggacuuuucccugugucaauaccaaucacggcagcugcaugguaucugugggaagugaaaaaacaacgagcuggaguauugugggaugucccuucacccccaccugugggaaaggccgaacuggaagauggagccuauagaaucaagcagaaagggauucuaggauacucgcagaucggggcuggaguuuacaaagaaggaacauuccacacaauguggcacgucacacgcggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacacuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccuaaucaucauggaugaagcccauuucacagacccagcaagcauagcagcuagaggauacauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaaugggucacggauuuuaaagggaagacuguuugguuuguuccaagcauaaaagcaggaaaugauauagcagcuugccugagaaagaaugggaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaauuacgcagacagaagauggugcuuugauggagucaagaacaaucaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcacuagacaacuuagcaguccugcauacggcugaagcaggcggaagggcguacaaucaugcucuuagugaacugccggagacccuggagacauugcuuuuacugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaggcauugcaacccagcaaccugagagcaacauccuggacauagaucuacguccugcaucagcuuggacucuauaugcuguggcaacaacuuucaucacaccaaugcugagacacagcauugaaaauuccucagugaaugugucucuaacggccauugcuaaccaagccacaguuuuaaugggucuugggaaaggauggccauugucaaaaauggacaucggaguuccccuucucgcuaucgggugcuauucacaaguuaaccccauaacucucacggcggcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgacugggcccaucuccacacugugggaaggaaauccagggagauuuuggaauacaacuauugcaguaucaauggcuaacauuuuuagagggagcuaccuggccggagccggacuucucuuuucuaucaugaagaauacggccaacacaagaaggggaacuggcaacacaggagagacgcuuggagaaaaauggaaaaaccgauugaaugcauuggggaagagugaauuccagaucuauaagaaaaguggaauccaggagguggauagaacccuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagauaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugaggagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguuuggcaaagcaaaaggcagcagagccauaugguacauguggcuuggagcacgcuucuuagaguuugaagcccuaggauucuugaaugaagaucacugguuuucccgagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcagcugacagccacagaagaaauugcagugaaaaacugguuagcaagagugggacgugagagguuaucaagaauggcuaucaguggagaugauuguguugugaaacccuuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccggguggucucugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccacacaugaguggaugacaacagaagauaugcugacagucuggaacaggguguggauucaagaaaacccauggauagaagacaaaacuccaguagaaucaugggaggaaaucccauauuuggggaaaagagaagaccaauggugcggcucauugaucgggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 7162 - RNA, 9876 nt, Artificial Sequence
  derived and/or modified CDS sequence (wt) from DENV-2__AY702036__SS-prME
acagcaggcgugauuguuauguugauuccaacagcgauggcguuccauuuaaccacacgcaauggagaaccacacaugaucguuggcaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcuaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcuaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaaucgugaaagaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucauuauaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuuccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccaugccagagaccauucuugaacugacugaugcguuagccuugggcaugaugguccucaaaauagugagaaauauggaaaaauaccaauuggcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucgauaacaauaucagaagauggcagcaugucgauaaaaaaugaagaggaagagcaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaaguauugaagacaauccagagaucgaagaugacauuuuccgaaagaaaagauugaccaucauggaccuccauccaggagcaggaaagacaaaaagauaccuuccagccauaguuagagaagccauaaaucguggcuugagaacauuaauccuggcucccacuagagucguggcagcugagauggaggaagcucuuagaggacuuccaauaagauaccaaaccccagccaucagagccgagcacaccgggcgggagaucguggaccuaaugugucacgccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucagcaggaagacuuuugacucugaguauguuaagacuagagccaaugauugggacuuuguggucacaacugacauuucagaaaugggugcuaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaacuuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauaggaaagaugacccugggaauguguugcauaaucacagcuagcagccuccuaugguaugcacagauccaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguagcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugugugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauugaacgcacugggaaaaagugaauuucagaucuacaagaaaaguggaauccaggaaguggauagaacccuagcaaaagaagguaucaaaagaggagaaacggaccaccaugcugugucacgaggaucagcaaaacugagaugguucgucgagagaaauauggucacaccggaagggaaggugguggaucucgguugcggcagagggggauggucauacuauugugggggacuaaagaauguaagagaagucaaaggccuaacaaaaggaggaccaggacacgaagaaccuauccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacucgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggaacugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaucugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgcauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 7163 - RNA, 9876 nt, Artificial Sequence
  derived and/or modified CDS sequence (wt) from DENV-2__AY702034__SS-prME
acagcaggcgugauuguuauguugauuccaacagcgauggcguuccauuuaaccacacgcaauggagaaccacacaugaucguuggcaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcuaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcuaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaaucgugaaagaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucauuauaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccaugccagagaccauucuugaacugacugaugcguuagccuugggcaugaugguccucaaaauagugagaaacauggaaaaauaccaauuggcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaaguauugaagacaauccagagaucgaagaugacauuuuccgaaagaaaagauugaccaucauggaccuccauccaggagcaggaaagacaaaaagauaccuuccagccauaguuagagaagccauaaaucguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucacgccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucagcaggaagacuuuugacucugaguauguuaagacuagagccaaugauugggacuuuguggucacaacugacauuucagaaaugggugcuaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaacuuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacagcuagcagccuccuaugguaugcacagauccaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguagcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauugaacgcacugggaaaaagugaauuucagaucuacaagaaaaguggaauccaggaaguggauagaacccuagcaaaagaagguaucaaaagaggagaaacggaccaccaugcugugucacgaggaucagcaaaacugagaugguucgucgagagaaauauggucacaccggaagggaaggugguggaucucgguugcggcagagggggauggucauacuauugugggggacuaaagaauguaagagaagucaaaggccuaacaaaaggaggaccaggacacgaagaaccuauccccaugucaacauauggguggaaucuagugcgucuucaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacucgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgcauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 7164 - RNA, 9876 nt, Artificial Sequence
  derived and/or modified CDS sequence (wt) from DENV-2__AF208496__SS-prME
acagcaggcgugauuguuauguugauuccaacagcgauggcguuccaucuaaccacacgcaauggagaaccacacaugaucguuggcaggcaggagaaagggaaaagucuucuguucaaaacagaggaugguguuaacauguguacccucauggccauagaccuuggugaauugugugaagauacaaucacguacaaguguccuuuccuuagacaaaaugaaccugaagacauagauuguuggugcaacuuuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucauccuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacuacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagagcacgcuguaggcaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgccaagaaacaggauguuguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccgaucguaacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacuaaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugcugggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuacgaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacucgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccaugccagagaccauucuugaacugacugaugcguuagccuugggcaugaugguccucaaaauagugagaaauauggaaaaauaccaauuagcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagacuuaauaucauauggaggaggcuggaagcuagaaggagaauggaaggaaggagaggaaguccaaguccuggcauuggaaccuggaaaaaaucccagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucacgccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaaguagagacccauuuccucagagcaaugcaccaaucauggaugaggaaagagaaaucccugagcguucguggaauucaggacaugaaugggucacggauuuuaaagggaaaacuguuugguuuguuccaaguauaaaagcaggaaaugacauagcagcuugucuuaggaaaaauggaaagaaagugauacaacucagcaggaagacuuuugacucugaguauguuaagacuagagccaaugauugggacuuuguggucacaacugacauuucagaaaugggugcuaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaauacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuagcagccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauugcaacccaggaaucugagagcaacauccuggacauagaucuacguccugcaucagcauggacgcuguaugccguagcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcagguaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauugaacgcacugggaaaaagugaauuucagaucuacaagaaaaguggaauccaggaaguggauagaacccuagcaaaagaagguaucaaaagaggagaaacggaccaccaugcugugucacgaggaucagcaaaacugagaugguucgucgagagaaauauggucacaccggaagggaaggugguggaucucgguugcggcagagggggauggucauacuauugugggggacuaaagaauguaagagaagucaaaggccuaacaaaaggaggaccaggacacgaagaaccuauccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacucgcaacauuggaauugaaagugagauaccaaaucuagacauaauaggaaagagaauagagaaaauaaaacaagagcaugaaacaucauggcauuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacggcaggaugggacacaagaaucacacuagaagacuuaaaaaaugaagaaaugguaacaaaccacaugaaaggagaacacaagaaacuagccgaggccauauucaaauuaacguaccaaaacaagguagugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccacaaacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccagacagcaauaaaucaagucagaucccuuauaggcaaugaggaauacacagauuacaugccauccaugaagagauucagaagggaagaggaagaggcagguguccugugguag

SEQ ID NO: 7165 - RNA, 9876 nt, Artificial Sequence
  derived and/or modified CDS sequence (wt) from DENV-2__AY702040__SS-prME
acugcaggcaugaucaucaugcugauuccaacagugauggcguuucaucugaccacacgcaacggagaaccacacaugaucgucaguagacaagaaaaagggaaaagccuucuguuuaagacaaaggauggcacgaacauguguacucucauggccauggaccuuggugaguugugugaagacacaaucacguauaaguguccuuuucucaagcagaacgaaccagaagacauagauuguuggugcaacuccacguccacauggguaacuuacgggacauguaccaccacaggagagcacagaagagaaaaaagaucaguggcgcuuguuccacacgugggaaugggauuggagacacgaacugaaacauggaugucaucagaaggggccuggaaacaugcccagagaauugaaacuuggauucugagacauccaggcuuuaccauaauggccgcaauccuggcauacaccauaggaacgacgcauuuccaaagaguccugauauucauccuacugacagccaucgcuccuucaaugacaaugcgcugcauaggaauaucaaauagggacuuuguggaaggagugucaggagggaguuggguugacauaguuuuagaacauggaaguugugugacgacgauggcaaaaaauaaaccaacauuggacuuugaacugauaaaaacagaagccaaacaacccgccaccuuaaggaaguacuguauagaggcuaaacugaccaacacgacaacagacucgcguugcccaacacaaggggaacccacccugaaugaagagcaggacaaaagguuugucugcaaacauuccaugguagacagaggauggggaaauggauguggauuguuuggaaaaggaggcaucgugaccugugcuauguucacaugcaaaaagaacauggaaggaaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguaacgauggagugcucuccaagaacgggccucgacuucaaugagaugguguugcugcaaauggaagacaaagcuuggcuggugcacagacaaugguuccuagaccuaccguugccauggcugcccggagcagacacacaaggaucaaauuggauacagaaagagacauuggucaccuucaaaaauccccaugcgaaaaaacaggauguuguuguccuaggaucccaagagggggccaugcauacagcacucacaggggccacggaaauccagaugucaucaggaaaccugcuguucacaggacaucucaaaugcaggcugagaauggacaaauuacaacuuaaagggaugucauacuccaugugcacaggaaaauuuaaaauugugaaggaaauagcagaaacgcaacauggaacaauagucauuagaguacaauaugaaggagacggcucuccaugcaagaucccuuuugagauaauggaucuggaaaaaagacauguuuugggccgccugaucacagucaacccaauuguaacagaaaaggacaguccagucaacauagaagcagaaccuccauucggagacagcuacaucaucauaggaguggaaccaggacaauuaaagcuggacugguucaagaaaggaaguuccaucggucaaauguuugagacaacaaugaggggagcgaaaagaauggccaucuugggcgacacagccugggauuuuggaucucugggaggaguguucacaucaauaggaaaagcucuccaccagguuuuuggagcaaucuacggggcugcuuucagugggguuucauggacuaugaagauccuuauaggaguuaucaucacauggauaggaaugaacucacguagcacaucacugucugugucacugguauuagugggaaucgugacacuguacuugggaguuauggugcaagccgauagugguugcguugugagcuggaagaacaaagaacuaaaauguggcaguggaauauucgucacagauaacgugcauacauggacagaacaauacaaguuccaaccagaauccccuucaaaacuggcuucagccauccagaaagcucacgaagaaggcaucuguggaauccgcucaguaacaagacuggaaaaucuuauguggaaacagauaacaucagaauugaaucauauucuaucagaaaaugaagugaaacugaccaucaugacaggagacaucaaaggaaucaugcagguaggaaaacgaucucugcggccucaacccacugaguugagguauucauggaaaacaugggguaaagcgaaaaugcucuccacagaacuccacaaucagaccuuccucauugauggucccgaaacagcagaaugccccaacacaaacagagcuuggaauucacuagaaguugaggacuauggcuuuggaguauucacuaccaauauauggcuaagauugagagaaaagcaggaugcauuuugugacccaaaacucaugucagcggccauaaaggacaacagagccguccaugcugauauggguuauuggauagaaagcgcacucaaugauacauggaagauagagaaagcuucuuucauugaagucaaaaguugccacuggccaaagucacacacucuauggaguaauggagugcuagaaagcgagaugguaauuccaaagaauuucgcuggaccagugucacaacauaauaacagaccaggcuaucacacacaaacagcaggaccuuggcaucuaggcaagcuugagauggacuuugauuucugcgaagggaccacaguggugguaaccgaggaauguggaaacagagggccuucuuuaagaacaaccacugccucaggaaaacucauaacggaaugguguugucgaucuugcacacuaccaccacuaagauacagaggugaggauggaugcugguacgggauggaaaucagaccauugaaagagaaagaagaaaaucuggucaguucucuggucacagccggacaugggcagauugauaauuucucauuaggaaucuugggaauggcgcuguuccuugaagaaaugcucaggacucgaguaggaacgaaacaugcaauacuacuagucgcagucucuuucguaacguuaaucacagggaacaugucuuuuagagaccugggaagagugaugguuauggugggugccaccaugacagaugacauaggcaugggugugacuuaucuugcucuacuagcagccuucaaagucagaccaaccuuugcagcuggacugcucuugagaaaacugaccuccaaggaauuaaugaugaccaccauaggaaucguucuucucucccagaguagcauaccagagaccauucuugagcugaccgaugcguuagccuuaggcaugaugguccucaagauggugagaaacauggaaaaauaucagcuggcagugacuaucauggcuauuuugugcgucccaaaugcugugauauuacagaacgcauggaaagugaguugcacaauacuggcaguggugucuguuuccccccugcucuugacauccucacagcagaaagcggacuggauaccauuagcguugacgaucaaaggccucaauccaacagccauuuuucuaacaacccucucaagaaccagcaagaaaaggagcuggccuuuaaacgaggccaucauggcgguugggauggugaguaucuuggccagcucucucuugaagaacgacauccccaugacaggaccauuaguggcuggagggcuucuuacugugugcuacguacuaacugggcggucagccgaucuggaacuagagagagcuaccgaugucaaaugggaugaucaggcagagauaucagguagcaguccaauucugucaauaauaauaucagaagauggcagcaugucaauaaagaaugaagaggaagagcaaacacugaccauacucauuagaacaggauugcuugugaucucaggacucuuuccgguaucaauaccaauuacagcagcagcaugguaccugugggaaguaaagaaacaacgggcuggaguguugugggauguccccucaccaccacccgugggaagggcugaauuggaagauggagccuacagaaucaagcaaaaaggaauucuuggauauucccagaucggagcuggaguuuacaaagaaggaacauuucacaccauguggcacgucacacguggcgcaguccuaaugcauaaggggaagaggauugaaccaucaugggcggacgucaagaaagacuuaauaucauauggaggagguuggaagcuagaaggagaauggaaagaaggagaagaaguccaggucuuggcauuggagccugggaaaaauccaagagccguccaaacaaaaccuggccuuuuuagaaccaauacuggaaccauaggcgccguaucucuggacuuuuccccugggacgucaggaucuccaaucguugacaaaaaaggaaaaguuguaggucucuauggcaaugguguuguuacaagggguggagcauaugugagugccauagcucagacugaaaaaagcauugaagacaauccagagauugaagaugacaucuuucgaaagagaagauugacuaucauggaucuccacccaggagcaggaaagacaaagagauaccucccggccauaguuagagaggccauaaaaagaggcuugagaacacuaauccuagcccccacuagagucguggcagcugaaauggaggaagcccuuagaggacuuccaauaagauaccaaacuccagccaucagggcugagcacaccgggcgggagaucguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaauuuuuaugacagccacuccuccggguagcagagauccauuuccucagaguaaugcaccaaucauggacgaagaaagagaaauuccggaacguucauggaacuccgggcacgagugggucacggauuucaaaggaaagacugucugguuuguuccaagcauaaaaaccggaaaugacauagcagccugccugagaaagaauggaaagagggugauacaacucaguaggaagaccuuugauucugaauacgucaagacuagaaccaaugacugggauuucgugguuacaacugacauuucggaaaugggugccaacuuuaaagcugagaggguuauagaccccagacgcugcaugaaaccaguuauacugacagacggcgaagagcgggugauucuagcaggacccaugccagugacccacuccagugcagcacaaagaagagggagaauaggaaggaauccaaggaaugaaaaugaucaauacauauauaugggagaaccccuggaaaaugaugaagacugugcgcacuggaaggaagcuaagaugcuccuagauaacaucaacacaccugaaggaaucauucccagcauguucgagccagagcgugaaaagguggaugccauugacggugaauaucgcuugagaggagaagcacggaaaacuuuuguggaccuaaugagaagaggagaccuaccagucugguuggcuuauaaaguggcagcugaagguaucaacuacgcagacagaagaugguguuuugacggaaccagaaauaaucaaaucuuggaagaaaauguggaaguggaaaucuggacaaaggaaggggaaaggaaaaaauugaaaccuagaugguuagaugcuaggaucuacuccgacccacuggcgcuaaaagaauucaaggaauucgcagccggaagaaaguccuuaacccugaaccuaaucacagagaugggcagacucccaacuuuuaugacucagaaggccagagaugcacuagacaacuuagcggugcugcacacggcugaagcggguggaaaagcauacaaucaugcccucagugaacuaccggagacccuggagacauugcuuuugcugacacuguuggccacagucacgggaggaaucuuucuauuccugaugagcggaagggguauagggaagaugacccugggaaugugcugcauaaucacggccagcauacucuuaugguaugcacaaauacaaccacauuggauagcagcuucaauaauauuggaguucuuucucauaguauugcucauuccagaaccagagaagcagaggacaccccaggauaaucaauugacuuaugucaucauagccauccucacagugguggccgcaaccauggcaaacgaaauggguuuucuagaaaaaacaaagaaagacuucggacugggacacauugcaacucagcaaccugagagcaacauucuggacauagaucuacguccugcaucagcauggacguuguaugccguggcaacaacauuuaucacaccaauguugagacauagcauugaaaauuccucaguaaaugugucccuaacagccauagcuaaccaagccacagugcuaaugggucucgggaaaggauggccauugucaaagauggacauuggaguuccccuccuugccauuggguguuacucacaagucaacccuauaacucucacagcggcucuucuuuuguugguagcacauuaugccaucauaggaccgggacuucaagccaaagcaaccagagaagcucagaaaagagcagcggcgggcaucaugaaaaacccaacuguggauggaauaacagugauagaucuagauccaauacccuaugauccaaaguuugaaaagcaguugggacaaguaaugcuccuaguccuuugugugacccaagugcugaugaugaggacuacgugggcuuugugugaagccuuaacucuagcaaccggacccguguccacauugugggaaggaaauccagggagauucuggaacacaaccauugcagugucaauggcaaacaucuucagagggaguuaccuugcuggagcuggacuucucuuuucuaucaugaagaacacaaccagcgcgagaagaggaacuggcaacaugggagaaacgcuaggagagaaauggaaaagcagacugaacgcauuggggaaaagugaauuccagaucuacaaaaaaaguggaauucaagaaguggacagaaccuuagcaaaagaaggcauuaaaagaggagaaacggaucaucacgcugugucgcgaggcucagcaaaacugagaugguucguugaaagaaauuuggucacaccagaagggaaaguaguggaccuugguugcggcagagggggcuggucauacuauuguggaggauugaagaauguaagagaaguuaaaggcuuaacaaaaggaggaccaggacacgaagaaccuaucccuaugucaacauauggguggaaucuaguacgcuuacagagcggaguugauguuuuuuuuguuccaccagagaagugugacacauuguugugugacauaggggaaucaucaccaaaucccacgguagaggcgggacgaacacucagaguccuuaaccuaguggaaaauuggcugaacaauaacacccaauuuugcguaaagguucuuaacccguacaugcccucagucauugaaagaauggaaaccuuacaacggaaauacggaggagccuuggugagaaauccacucucacggaauuccacacaugaaauguacuggguguccaaugcuuccgggaacauagugucaucagugaacaugauuucaagaaugcugauuaacagauucaccaugagacacaagaaggccaccuaugagccagaugucgaccucggaagcggaacccgcaacauuggaauugaaagugagacaccgaaccuagacauaauugggaaaagaauagaaaaaauaaaacaggagcaugaaacgucauggcacuaugaccaagaccacccauacaaaacaugggcuuaccaugguagcuaugaaacaaaacagacaggaucagcaucauccauggugaacggaguagucagacugcugacaaagcccugggacguuauuccaauggugacacagauggcaaugacagacacaacuccuuucggacaacagcgugucuucaaagagaagguggauacgagaacccaagaaccaaaagaaggcacaaaaaaacuaaugaaaaucacagcagaguggcucuggaaagaacuaggaaagaaaaagacaccuagaaugugcaccagagaagaauucacaaaaaagguaagaaguaaugcagccuugggggccauauuuaccgaugagaacaaguggaagucggcgcgugaggcuguugaagacaauagguuuugggagcugguugacaaggaaagaaaccuccaucuugaaggaaaaugugaaacauguguauacaacaugaugggaaaaagagagaaaaaacuaggagaguuugguaaagcaaaaggcagcagagccauaugguacauguggcucggagcacgcuucuuagaguuugaagcccuaggauuuuugaaugaagaccauugguucuccagagagaacucccugaguggaguggaaggagaagggcugcauaaacuagguuacaucuuaagagaggugagcaagaaagaaggaggagcaauguaugccgaugauaccgcaggcugggacacaagaaucacaauagaggauuuaaaaaaugaagaaaugauaacgaaccacauggcaggagaacacaagaaacuugccgaggccauuuuuaaauugacguaccaaaacaagguggugcgugugcaaagaccaacaccaagaggcacgguaauggacaucauaucgagaaaagaccaaagggguaguggacaaguuggcaccuauggccucaacacuuucaccaacauggaagcacaacuaauuaggcaaauggagggggaaggaaucuucaaaagcauccagcacuugacagccucagaagaaaucgcugugcaagauuggcuaguaagaguagggcgugaaagguugucaagaauggccaucaguggagaugauuguguugugaaaccuuuagaugauagauuugcaaaagcucuaacagcucuaaaugacaugggaaagguuaggaaggacauacagcaaugggagcccucaagaggauggaacgacuggacacaggugcccuucuguucacaccauuuucacgaguuaauuaugaaagauggucgcacacuuguaguuccaugcagaaaucaagaugaauugaucggcagagcccgaauuucccagggagcuggguggucuuuacgggagacggccuguuugggaaagucuuacgcccaaauguggagcuugauguacuuccacagacgugaucucaggcuagcggcaaaugccauuugcucggcagucccgucacacuggguuccaacaagccggacaaccuggucuauacacgccagccaugaauggaugacgacggaagacauguugacaguuuggaacagaguguggauccuagagaauccauggauggaagacaaaacuccaguggaaucaugggaggaaaucccauaccugggaaaaagagaagaccaauggugcggcucacugauugggcugacaagcagagccaccugggcgaagaauauccagacagcaauaaaccaagucagaucccucauuggcaaugaggaauacacagauuacaugccauccaugaaaagauuuagaagagaagaggaagaggcaggaguuuugugguag

SEQ ID NO: 7166 - RNA, 9876 nt, Artificial Sequence
  derived and/or modified CDS sequence (wt) from DENV-2__AY037116__SS-prME
acugcagguauaauuauuaugaugauuccaacagugauggcguuccauuuaaccacacgcaacggagaaccacacaugaucgucaguagacaagagaaggggaaaagucuucuguuuaaaacagagaacggugugaacauguguacccucauggccauggaccuuggugaauugugugaagacacaaucacuuauaauuguccucuucucaggcagaaugaaccagaagacauagacugugggugccacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcauacaccauaggaacgacauauuuccaaagaguccugauuuucaucuuacugacagcugucacuccuucaaugacaaugcguuguauaggaauaucaaauagggacuuuguggaagggguuucaggaggaagcuggguugacauagucuuggaacauggaagcugugugacgacgauggcgaaaaauaaaccaacauuggauuuugaacugguaaaaacagaagccaaacaucccgccacucuaaggaaguauuguauagaagcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauuguuacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuauauuugggaguuauggugcaggccgauaguggcugcguugugaguuggaaaaacaaagaacugaaauguggcagugggauuuuuaucacagacaacgugcacacauggacagaacaauacaaauuccaaccagaauccccuucaaagcuggcuucagcuauccagaaggcucaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguagugacugaggacuguggaaacagaggacccucuuuaagaacaacuacugcuucuggaaaacucauaacagaauggugcugccgauccugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucucgcccuauuagcagccuucaaagucagaccaacuuucgcagcuggacuacucuuaagaaagcugaccuccaaggaauugaugaugaccaccauaggaaucguacuccucucucagagcaccauaccagagacuauacuugaacugacugacgcgugggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucaauaacaauaucggaagaugguagcaugucgauaaaaaaugaagaagaagaacaaacacugaccauacucauuagaacaggacugcuggugauaucaggacuuuuucccgcgucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuucucuccuggaacgucaggaucuccaauugucgacaaaaaaggaaaaguugugggccuuuauggcaacggugucgucacaaggaguggagcauaugugagugccauagcccagacugaaaaaagcaucgaagacaauccagagauugaagaugacaucuuucgaaagaaaagauugaccaucauggaccuccacccaggagcgggaaaaacaaagagauaccuuccagcaauaguuagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcugcuaucaccaauuagagugccaaauuacaaccugaucaucauggaugaagcccauuucacagacccagcaagcauagcagcuagaggauacauuucaacucgaguagagaugggugaagcagcugggauuuucaugacagcuacuccuccuggaagcagagacccauuuccucagagcaaugcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacugacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuugagaggagaagcgaggaaaacuuuuguggaccuaaugagaagaggagaccuaccagucuggcuagccuacagaguggcugcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuggaugccaggaucuacucugacccacuggcgcucaaagaauucaaggaauucgcagcuggaagaaagucccugacucugaaucuaaucacagagauggguaggcucccaaccuucaugacccagaaagcaaggaaugcacuggacaacuuagcaguccugcauacggcugaagcaggcggaagggcguacaaucaugcucuuagugaacugccggagacccuggagacauugcuuuuacugacacuuuuggccacagucacgggcggaaucuuccuguucuugaugagcggaaaggguauagggaagaugacccugggaaugugcugcauaaucacggccaguauucuccuaugguaugcacaaauacagccacacuggauagcagccucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauugcaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacggcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauuacugugugacauaggggagucgucaccaaaccccacgguugaggcaggacgaacacucagaguucuaaacuuaguggaaaauuggcugaacaacaacacccaauuuugcauaaagguucucaacccauauaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagacaccaaauuuagacauaauugggaaaagaauagagaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacaucaucccuauggugacacagauggcaaugacagacacgacuccauuugggcaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccauguagaaaccaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7167 - RNA, 9876 nt, Artificial Sequence
  derived and/or modified CDS sequence (wt) from DENV-2__AF169678__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagaaucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcagccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagaaaagacugaccaucauggaccuccacccaggggcaggaaagacgaaaagauaccuuccggccauagucagagaagcuauaaaacgggguuugaggacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauucagaacaaccaaauccuggaagaaaauguggaaguggaaaucuggacaaaagaaggggaaaggaagaaauugaaacccagguggcuggacgcuaggaucuauucugacccacuggcgcuaaaagaauucaaagaauuugcagcuggaagaaagucucugacccugaaccuaaucacagaaauggguaggcuuccaacuuucaugacucagaaggcaagagacgcauuggacaacuuagcaguucugcacacggcugaagcagguggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuccaagcaaaagcaaccagagaagcucagaaaagagcagcggcggguauuaugaaaaacccaaccgucgauggaauaacagugaucgaucuagauccaauaccuuaugauccaaaguuugaaaagcaguugggacaaguaaugcuccuaguccucugugugacucaaguauugaugaugaggacuacaugggcucugugugaggcuuuaaccuuagcgacagggcccaucuccacauugugggaaggaaauccagggagguuuuggaacacuaccauugcagugucaauggcuaauauuuuuagagggaguuacuuggcuggagcuggacuucucuuuuccaucaugaagaacacaaccaacacaagaaggggaacuggcaacauaggagagacgcuuggagagaaauggaaaagccgacugaacgcacuggggaaaagugaauuccagaucuacaagaaaaguggaauccaggaaguggauagaacauuagcaaaagaaggcaucaaaagaggagaaacggaccaucacgcugugucgcgaggcucagcaaaacugagaugguucguugagagaaacaugaucacaccagaagggaaaguaguggaccucgguuguggcagaggaggcuggucauacuauugugggggacuaaagaauguaagagaagugaaaggccugacaaagggaggaccaggacacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacauccuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcgggcaaguugguaccuauggacucaacacuuucacuaauauggaagcccaacuaaucagacagauggaaggagaaggagucuuuaaaaacauucagcaccugacagccacagaagaaauugccgugcaaaacugguuagcaagaguggggcgcgaaagguuaucaagaauggccaucaguggagaugacuguguagugaaaccuuuagaugacagguucgcaagugcuuugacagcucuaaaugacaugggaaaggucaggaaggacauacaacaaugggaaccuucaagaggguggaaugauuggacacaggugcccuucuguucacaccauuuccaugaguuaaucaugaaagacggucguguacuuguaguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7168 - RNA, 9876 nt, Artificial Sequence
  derived and/or modified CDS sequence (wt) from DENV-2__AF169679__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacgcuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggccccaaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuggcagugacuaucauggcuaucuugugcgucccaaaugcagugauauuacaaaaugcauggaaagugaguugcacaauacuggcagugguguccguuuccccacugauauugacauccucacagcagaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugacauucccaugacaggaccacuaguggcuggagggcuccucacugugugcuacgugcucacuggacgaucggccgacuuggaacuggagagagcagccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccagguccuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagauugaagaugacauuuuccgaaagagaagacugaccaucauggaccuccacccaggggcgggaaagacgaaaagauaccuuccggccauagucagagaagccauaaaacgggguuugaggacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggaaaugggugaggcagcugggauuuucaugacagccacucccccgggaaguagagauccauuuccucagagcaaugcaccaaucauggaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccugaaggaaucauucccaguauguuugaaccagagcgugaaaaaguggaugccauugauggugaauaccgcuugagaggagaagcacggaaaaccuuuguggacuuaaugagaagaggagaccuaccagucugguuggccuacaaaguggcagcugaaggcaucaacuaugcagacagaaggugguguuuugauggaaucaggaacaaccaaauccuggaagaaaauguggaaguggaaaucuggacaaaagaaggggaaaggaagaaauugaaacccagguggcuggacgcuaggaucuauucugacccacuggcgcuaaaagaauucaaagaauuugcagcuggaagaaagucucugacccugaaccuaaucacagaaauggguaggcuuccaacuuucaugacucagaaggcaagagacgcauuggacaacuuagcaguucugcacacggcugaagcagguggaagggcguacaaucaugcccucagugaacugccggagacccuagagacacugcuuuuacugacacuucuggcuacagucacaggaggaaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuccaagcaaaagcaaccagagaagcucagaaaagagcagcggcggguauuaugaaaaacccaaccgucgauggaauaacaguaaucgaucuagauccaauaccuuaugauccaaaguuugaaaagcaguugggacaaguaaugcuccuaguccucugugugacucaaguauugaugaugaggacuacaugggcucugugugaggcuuuaaccuuagcgacagggcccaucuccacauugugggaaggaaauccagggagguuuuggaacacuaccauugcagugucaauggcuaauauuuuuagagggaguuacuuggcuggagcuggacuucucuuuuccaucaugaagaacacaaccaacacaagaaggggaacuggcaacauaggagagacgcuuggagagaaauggaaaagccgacugaacgcacuggggaaaagugaauuccagaucuacaagaaaaguggaauccaggaaguggauagaacauuagcaaaagaaggcaucaaaagaggagaaacggaccaucacgcugugucgcgaggcucagcaaaacugagaugguucguugagagaaacaugaucacaccagaagggaaaguaguggaccucgguuguggcagaggaggcuggucauacuauugugggggacuaaagaauguaagagaagugaaaggccugacaaagggaggaccaggacacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacaaacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacauccuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcgggcaaguugguaccuauggacucaacacuuucacuaauauggaagcccaacuaaucagacagauggaaggagaaggagucuuuaaaaacauucagcaccugacagccacagaagaaauugccgugcaaaacugguuagcaagaguggggcgcgaaagguuaucaagaauggccaucaguggagaugacuguguagugaaaccuuuagaugacagguucgcaagugcuuugacagcucuaaaugacaugggaaaggucaggaaggacauacaacaaugggaaccuucaagaggguggaaugauuggacacaggugcccuucuguucacaccauuuccaugaguuaaucaugaaagacggucguguacuuguaguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7169 - RNA, 9876 nt, Artificial Sequence
  derived and/or modified CDS sequence (wt) from DENV-2__AF169680__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguauaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaacuuucucauugauggccccgaaacggcagaaugccccaacacaaauagagcuuggaacucguuggaggucgaagacuacggcuuuggaguguucaccaccaacguauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucucaaagcacuauaccagagaccauucuugaauugacugaugcguuagccuuaggcaugaugguccucaaaauaguaagaaacauggaaaaguaucaauuagcagugacuaucauggcuaucuugugcgucccuaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaacgacaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaaagaugaccaucauggaccuccacccaggggcgggaaagacgaaaagauaccuuccggccauagucagagaagcuauaaaacgggguuugaggacauuaaucuuggcccccaccagagucguggcagcugaaauggaggaagcucuaaggggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggugaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaggaacaaccaaauccuggaagaaaauguggaaguggaaaucuggacaaaagaaggggaaaggaagaaauugaaacccagauggcuggacgcuaggaucuauucugacccacuggcgcuaaaagaauucaaagaauuugcagcuggaagaaagucucugacccugaaccuaaucacagaaauggguaggcuuccaacuuucaugacucagaaggcaagagacgcauuggacaacuuagcaguucugcacacggcugaagcagguggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuccaagcaaaagcaaccagagaagcucagaaaagagcagcggcggguauuaugaaaaacccauccgucgauggaauaacagugaucgaucuagauccaauaccuuaugauccaaaguuugaaaagcaguugggacaaguaaugcuccuaguccucugugugacucaaguauugaugaugaggacuacaugggcucugugugaggcuuuaaccuuagcgacagggcccaucuccacauugugggaaggaaauccagggagguuuuggaacacuaccauugcagugucaauggcuaauauuuuuagagggaguuacuuggcuggagcuggacuucucuuuuccaucaugaagaacacaaccaacacaagaaggggaacuggcaacauaggagagacgcuuggagagaaauggaaaagccgacugaacgcacuggggaaaagugaauuccagaucuacaagaaaaguggaauccaggaaguggauagaacauuagcaaaagaaggcaucaaaagaggagaaacggaccaucacacugugucgcgaggcucagcaaaacugagaugguucguugagagaaacaugaucacaccagaagggaaaguacuggaccucgguuguggcagaggaggcuggucauacuauugugggggacuaaagaauguaagagaagugaaaggccugacaaagggaggaccaggacacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacgugggcauaccaugguagcuacgaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacauccuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcgggcaaguugguaccuauggacucaacacuuucacuaauauggaagcccaacuaaucagacagauggaaggagaaggagucuuuaaaaacauucagcaccugacagccacagaagaaauugccgugcaaaacugguuagcaagaguggggcgcgaaagguuaucaagaauggccaucaguggagaugacuguguagugaaaccuuuagaugacagguucgcaagugcuuugacagcucuaaaugacaugggaaaggucaggaaggacauacaacaaugggaaccuucaagaggguggaaugauuggacacaggugcccuucuguucacaccauuuccaugaguuaaucaugaaagacggucguguacuuguaguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7170 - RNA, 9876 nt, Artificial Sequence
  derived and/or modified CDS sequence (wt) from DENV-2__AF169682__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccuaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaagccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaagauaccuuccggccauagucagagaagcuauaaaacgggguuugagaacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggaggaagggcguacaaucaugcccucagugaauugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguuguggcagaggaggcuggucuuacuauuguggaggacuaaagaauguaagagaagugaaaggccuaacaaaaggaggaccaggacacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacgugggcauaccaugguagcuacgaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcacgcuuccuggaguuugaagccuuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaccaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugcuuagcaagauuggggcgcgaaagguuaucaagaauggccaucaguggagaugauuguguagugaaaccuuuagaugacagguucgcaagugcuuugacagcucuaaaugacaugggaaagauuaggaaggacauacaacaaugggaaccuucaagaggauggaaugauuggacacaggugcccuucuguucacaccauuuccaugaguuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7171 - RNA, 9876 nt, Artificial Sequence
  derived and/or modified CDS sequence (wt) from DENV-2__AF169681__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccaccuuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacgcuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagaaucucauaaccaaaccuuucucauugauggccccaagacggcagaaugccccaacacaaauagagcuuggaacucguuggaggucgaagacuacggcuuuggaguguucaccaccaauauauggcuaaaauugaaagaaaaacaggaugcauugugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaaaaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaagauaccuuccggccauagucagagaagcuauaaaacgggguuugagaacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaauacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggcggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaucuagugcgucuucagaguggaguugacguuuucuucaucccgccagaaaagugugacacauuguugugugacauaggggagucaucaccaaaucccacaguggaagcaggacgaacacucagaguccuuaauuuaguagaaaauuggcugaacaacaacacucaauucugcauaaaaguucucaacccauauaugcccucaguuauagaaaaaauggaagcacugcaaaggaaauauggaggagccuuagugagaaauccacucucacggaacuccacacaugagauguacuggguauccaaugcuuccgggaacauagugucaucagugaacaugauuucaagaauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagccuuaggauuccuaaaugaagaucacugguucuccagagagaacucccugaguggaguggaaggagaagggcugcacaagcuacguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggaguuuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7172 - RNA, 9876 nt, Artificial Sequence
  derived and/or modified CDS sequence (wt) from DENV-2__AF169683__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagauuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauaguuuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaugcaggaaaacgaucucugcggccucagcccacugagcuaaaguauucauggaaaacauggggcaaagcaaaaaugcucuccacagagucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaagauaccuuccggccauagucagagaagcuauaaaacgggguuugagaacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacuuuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggcggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacugggaaaaagugaaucacagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguuguggcagaggaggcuggucauacuauuguggaggaauaaaaaacguaagagaagugaaaggccuaacaaaaggaggaccaggacacgaagaacccauccccaugucaacauauggguggaaucuagugcgucuucagaguggaguugacguuuucuucaucccgccagaaaagugugacacauuguugugugacauaggggagucaucaccaaaucccacaguggaagcaggacgaacacucagaguccuuaauuuaguagaaaauuggcugaacaacaacacucaauucugcauaaaaguucucaacccauauaugcccucaguuauagaaaaaauggaagcacugcaaaggaaauauggaggagccuuagugagaaauccacucucacggaacuccacacaugagauguacuggguauccaaugcuuccgggaacauagugucaucagugaacaugauuucaagaauguugaucaacagauucacaaugagacacaagaaagccacuuaugagccggauguugaccucggaagcggaacccguaacauuggaauugaaagugaaauaccaaaccuagacauaauugggaaaagaauagaaaaaauaaagcaagagcaugaaacaucauggcauuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagccuuaggauuccuaaaugaagaucacugguucuccagagagaacucccugaguggauuggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7173 - RNA, 9876 nt, Artificial Sequence
  derived and/or modified CDS sequence (wt) from DENV-2__AF169684__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaagaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaaaauaccuuccggccauagucagagaagcuauaaaacgggguuugagaacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaagugauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacuuuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugaggggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggcggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauauuuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaagugguggaccucgguuguggcagaggaggcuggucauacuauuguggaggacuaaaaaacguaagagaagugaaaggccuaacaaaaggaggaccaggacacgaagaacccauccccaugucaacauauggguggaaucuagugcgucuucagaguggaguugacguuuucuucaucccgccagaaaagugcgacacauugcugugugacauaggggagucgucaccaaaucccacgguagaggcaggacggacacucagaguccucaacuuaguggaaaauugguugaacaacaacacccaauuuugcauaaagguucucaacccauacaugcccucagucauagaaaaaauggaagcacuacaaaggagauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugacuuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagccuuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7174 - RNA, 9876 nt, Artificial Sequence
  derived and/or modified CDS sequence (wt) from DENV-2__AF169685__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcgaaaaugcucuccacagaaucucauaaccagaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauugccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccuaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaagauaccuuccggccauagucagagaagcuauaaaacgggguuugagaacuuuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacuuuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggaggaagggcguacaaucaugcccucagugaauugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacuggggaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaucuagugcgucuucagaguggaguugacguuuucuucaucccgccagaaaagugugacacauugcugugugacauaggggagucaucaccaaaucccacgguggaggcaggacggacacucagaguccucaacuuaguggaaaauugguugaacaacaacacccaauucugcauaaagguucucaacccauacaugcccucagucauagaaaaaauggaagcacuacaaaggagauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccggauguugaccucggaagcggaacccgcaacauuggaauugaaagugagguaccaaaccuggacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagccuuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7175 - RNA, 9876 nt, Artificial Sequence
  derived and/or modified CDS sequence (wt) from DENV-2__AF169686__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaaucuucauaggagucauuaucacauggauaggaaugaacucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccaguaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaaaauaccuuccggccauagucagagaagcuauaaaacgggguuugagaacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacuuuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugaggggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggcggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguuguggcagaggaggcuggucauacuauuguggaggacuaaaaaacguaagagaagugaaaggccuaacaaaaggaggaccaggacacgaagaacccauccccaugucuacauauggguggaaccuagugcgucuucaaaguggaguugacguuuucuucacuccgccagaaaagugcgacacauugcugugugacauaggggagucgucaccaaaucccacgguagaggcaggacggacacucagaguccucaacuuaguggaaaauugguugaacaacaacacccaauuuugcauaaagguucucaacccauacaugcccucagucauagaaaaaauggaagcacuacaaaggagauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugacuuaggaagcggaacccgcaacauuggaauugaaagugagguaccaaaccuggacauaauugggaaaagaauagaaaaaauaaaacaagagcaugaaacaucauggcacuaugaccaagaucacccauacaaaacgugggcuuaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaaaccuuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcuggcagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7176 - RNA, 9876 nt, Artificial Sequence
  derived and/or modified CDS sequence (wt) from DENV-2__AF169687__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuaucagaaaaugaggugaaguuaacuaucaugacaggagacaucaaaggaaucaugcaugcaggaaaacgaucucugcggccucagcccacugagcuaaaguauucauggaaaacauggggcauagcaaaaaugcucuccacagagucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuacgguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaagauaccuuccggccauagucagagaagcuauaaaacgggguuugagaacauuaaucuuggcccccaccagagucguggcagcugaaauggaggaagcucugagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauuuuggcaggacccaugccagugacccacuuuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggcggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggagagacgcuuggagagaaauggaaaagccgacugaacgcacugggaaaaagugaauuccagauauacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguucuggcagaggaggcuggucauacuauuguggaggacuaaaaaacguaagagaagugaaaggccuaacaaaaggaggaccaggacacgaagaacccauccccaugucaacauauggguggaaucuagugcgucuucagaguggaguugacguuuucuucaucccgccagaaaagugugacacauuguugugugacauaggggagucaucaccaaaucccacaguggaagcaggacgaacacucagaguccuuaauuuaguagaaaauuggcugaacaacaacacucaauucugcauaaaaguucucaacccauauaugcccucaguuauagaaaaaauggaagcacugcaaaggaaauauggaggagccuuagugagaaauccacucucacggaacuccacacaugagauguacuggguauccaaugcuuccgggaacauagugucaucagugaacaugauuucaagaauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagccuuaggauuccuaaaugaagaucacugguucuccagagagaacucccugaguggaguggaaggagaagggucgcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7177 - RNA, 9876 nt, Artificial Sequence
  derived and/or modified CDS sequence (wt) from DENV-2__AF169688__SS-prME
ucugcaggcaugaucauuaugcugauuccaacagugauggcguuucaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuagguucccaagaaggggccaugcacacagcacucacaggagccacagaaauccaaacgucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguagaaucccuuuugagauaauggauuuggaaaaaagauaugucuuaggccgccugaucacagucaacccaauugugacagaaaaagauagcccagucaacauagaagcagaaccuccauuuggagacagcuacaucaucauaggaguagagccgggacaacugaagcucaacugguucaagaaaggaaguucuaucggccaaauguuugagacaacaaugagaggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaauucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaugcaggaaaacgaucucugcggccucagcccacugagcuaaaguauucauggaaaacauggggcaaagcaaaaaugcucuccacagagucucauaaccaaaccuuucucauugauggccccgaaacggcagaaugccccaacacaaauagagcuuggaacucguuggaggucgaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaauugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacuuuugagaaagcugaccuccaaggaauugaugaugacuaccauaggaauuguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugauuuugacauccucacagcaaaaaacggauuggauaccauuagcauugacaaucaaaggucucaauccaacagccauuuuucuaacaacccucucaagaaccaacaagaaaaggagcuggccacuaaaugaagcuaucauggcagucggaauggugagcauuuuggccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccaccuaugggaaaggcugaacuggaagacggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuauucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcaauagcccaaacugaaaaaagcauugaagacaacccagagaucgaagaugacauuuuccgaaagagaagacugaccaucauggaccuccacccaggggcgggaaagacgaaaagauaccuuccggccauagucagagaagcuauaaaacgggguuugagaacauuaaucuuggcccccaccagagucguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugaucaucauggacgaagcccauuucacagacccagcaaguauagcagcuagaggauacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggacuucgugguuacaacugacauuucagaaaugggugccaauuucaaagcugagaggguuauagaccccagacgcugcaugaaaccagucauacuaacagauggugaggagcgggugauucuggcaggacccaugccagugacccacuuuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauccuggaagaaaauguggaaguugagaucuggacaaaagaaggggaaagaaagaaauugaaacccagauggcuggacgcuaggaucuauucugacccacuggcgcuaaaagaauucaaagaauuugcagccggaagaaagucucuggcccugaaccuaaucacagaaauggguaggcuuccgacauucaugacucagaagacaagagacgcacuggacaacuuagcaguucugcacacggcugaagcaggaggaagggcguacaaucaugcccucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacugguguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuuggaaguauugcaacccagcaacccgagagcaacauccuggacauagaucuacgucccgcaucagcuuggacgcuguaugccguggcuacaacauuuguuacaccaaugcugagacauagcauugagaauuccucagugaaugugucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcggguauuaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacacuaccauugcggugucaauggcuaauaucuuuagagggaguuacuuggcuggagcuggacuucucuuuuccauuaugaagaacacaaccaacacaagaaggggaacuggcaacauaggaaagacgcuuggagagaaauggaaaagccgacugaacgcacugggaaaaauugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacaugguuacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaucuagugcgucuucagaguggaguugacguuuucuucaucccgccagaaaagugugacacauuguugugugacauaggggagucaucaccaaaucccacaguggaagcaggacgaacacucagaguccuuaauuuaguagaaaauuggcugaacaacaacacucaauucugcauaaaaguucucaacccauauaugcccucaguuauagaaaaaauggaagcacugcaaaggaaauauggaggagccuuagugagaaauccacucucacggaacuccacacaugagauguacuggguauccaaugcuuccgggaacauagugucaucagugaacaugauuucaagaauguugaucaacagauucacaaugagacacaagaaagccacuuacgagccggauguugaccucggaagcgggacccguaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggagccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagccuuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaagaacauccagcaccugacagccacagaagaaauugccgugcaaaacugguuagcaagaguggggcgcgaaagguuaucaagaauggccaucaguggagaugauuguguagugaaaccuuuagaugacagguucgcaagcgcuuugacagcucuaaacgacaugggaaagauuagaaaggacauacaacaaugggaaccuucaagaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 7178 - RNA, 9873 nt, Artificial Sequence
  derived and/or modified CDS sequence (wt) from DENV-3__AB189125__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaagugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccaaaccuggaugucggcugaaggagcuuggagacaagucgagaagguagagacaugggccuuuaggcacccaggguucacgauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugcgugacuaccauggcuaagaacaagcccacgcuggacauagagcuccagaagaccgaggccacccaacuggcaacccuaaggaaacuaugcauugagggaaaaaucaccaacgugacaaccgacucaaggugccccacccaaggggaagcgauucuaccugaggagcaggaccagaacuacguguguaagcacacauacguggacagaggcuggggaaacgguugugguuuguuuggcaagggaagcuugguaacaugcgcaaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaacugucgaagccaucuuaccugaauauggaacccuugggcuagaaugcucaccacggacagguuuggauuucaaugaaaugauuuuguugacaaugaagaacaaagcauggaugguacauagacaaugguuuuuugaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagcuacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagcccugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaacuggaaaggcaaagaacucaaauguggaaguggaauuuuuguuacuaaugagguccacaccuggacagagcaauacaaauuucaagcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauugggaucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaaacuccgagaaauguacacccaacuaugugaccacaggcuaaugucggcagccguuaaggaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuggagagugacaugaucaucccaaagagucuggcugguccuaucucgcaacacaauuacaggcccggauaccacacccaaacggcaggaccauggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucucuagucucagcagggaguggaaagguggauaacuucacaaugggugucuugugucuugcaauccucuuugaagagguaaugagaggaaaauucgggaaaaagcacaugauugcagggguucucuucacauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuggucucccuaauguguucaaacacaauuuucacguugacuguugccuggagaacagccacccugauuuuggccggaauuucgcuuuugccagugugccagucuucgagcaugaggaaaacagauuggcucccaaugacuguggcagcuaugggaguuccaccucuaccacuuuuuauuuucaguuugaaagacacacucaaaaggagaagcuggccacugaaugagggggugauggccguuggacuugugagcauucuggcaaguucucuccuuaggaaugacguacccauggcuggaccauuaguggcugggggcuugcugauagcgugcuacgucauaacuggcacgucagcagaccucacuguagaaaaagcagcagaugugacaugggaagaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccacacuauguggcacgucacaagaggagcaguguugacauacaauggaaaaagacuggaaccaagcugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcauugaaagggcucccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacaccuccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcugggaaugacauagcaaacugcuugcggaaaaauggaaaaaaggucauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcaggaccaaugccagucaccguagcgagugcugcgcaaaggagagggagaguuggcaggaacccacaaaaagaaaaugaccaauacauauucacgggccagccucucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauguggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcucacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggugaugcuuuucuugauaucaggcaaagggguuggaaagacuucaauaggacucauuuguguaguugcuucuagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccagguguuguuucgccaaccagcuauuuggauguggauuugcacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacuggguugcuauucacaagugaacccacuaacucucacagcggcaguacuccugcuagucacgcauuaugcuaucauagguccaggauugcaggcaaaagccacucgugaagcucaaaaaaggacggcugcuggaauaaugaagaauccaacgguggaugggauaaugacaauagaccuagauccuguaauauacgacucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaaucuggaaucacugaaguggauagaacagaagccaaagaaggguugaaaagaggagaaauaacacaccaugccguauccagaggcagcgcaaaacuucaaugguucguggagagaaacauggucauuccugaaggaagagucauagacuugggcuguggaagaggaggcuggucauauuauugugcaggauugaaaaaaguuacagaagugcgaggauacacaaaaggcggcccaggacaugaagaaccaguaccuaugucuacguauggauggaacauagucaagcugaugaguggaaaggauguguuuuaccuuccaccugaaaagugugacacucuauugugugacauuggagaaucuucaccaagcccaacaguggaagagagcagaaccauaagagucuugaaaaugguugaaccauggcuaaaaaauaaccaguuuugcauuaaaguauugaacccuuacaugccagcugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauaggagacccaccauagagaaagauguggauuuaggagcggggacccgacaugucaaugcggaaccagaaacacccaacauggacgucauuggggaaagaauaagaaggaucaaggaggagcauaguucaacauggcacuaugaugaugaaaauccuuacaaaacgugggcuuaccauggaucuuaugaggucaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaauucuuacaguggaguagaaggggaaggacugcauaagcugggauacaucuugagagauauuuccaagauacccggaggagcuauguaugcugaugacacagcuggaugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaagaauggccaucagcggggaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaucucaggaugaauuaauagggagagcgagaaucucucagggagcaggauggagccuuaaagaaacugcaugccuagggaaagccuacgcccaaaugugggcucucauguauuuucacagaagagaucuuagacuagcauccaaugccauauguucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7179 - RNA, 9873 nt, Artificial Sequence
  derived and/or modified CDS sequence (wt) from DENV-3__AB189126__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccaaaccuggaugucagcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagccacguggguugacguggugcucgaacacggugggugugugacuaccauggcuaagaacaagcccacgcuggacauagagcuccagaagaccgaggccacccaacuggcaacccuaaggaaacuaugcauugagggaaaaaucaccaacgugacaaccgacucaaggugccccacccaaggggaagcgauucuaccugaggagcaggaccagaacuacguguguaagcacacauauguggacagaggcuggggaaacgguugugguuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacaaugguuuuuugaccuaccucuaccauggacaucaggggcuacaacagaaacaccaaccuggaauaagaaagagcuucuugugacauucaaaaaugcacacgcaaaaaaacaagaaguaguaguccuuggaucgcaagagggagcaaugcacacagcacugacaggagcuacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaagguugaguacaaaggggaagacgcaccuugcaagauucccuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaacuggaaaggcaaagaacucaaauguggaaguggaauuuucguuacuaaugagguccacaccuggacagagcaauacaaauuucaagcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaguagugacagcugaaauacaaaauuccuccuuuauaauagaugggccaaacacaccagaguguccaaacgccucaagagcauggaacgugugggagguggaagauuacggguucggagucuucacaacuaauauaugguugaaacuccgagagauguacacccaacuaugugaccacaggcuaaugucggcagccguuaaggaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuggagagugacaugaucaucccaaagagucuggcugguccuaucucgcaacacaacuacaggcccggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguggauaacuucacaaugggugucuugugucuugcaauucucuuugaagagguaaugagaggaaaauucgggaaaaagcacaugauugcagggauucucuucauauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuagucucccuaacguguucaaacacaauuuucacguugacuguugccuggagaacagccacccugauuuuggccggaauuucgcuuuugccagugugccagucuucgagcaugaggaaaacagauuggcucccaaugacuguggcagcuaugggaguuccaccucuaccacuuuuuauuuucaguuugaaagacacacucaaaaggagaagcuggccacugaaugagggggugauggccguuggacuugugagcauucuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggguguuggaguacaaaaagaaggaguuuuccacacuauguggcacgucacaagaggagcaguguugacauacaauggaaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcauugaaagggcucccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacaccuccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccaugcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcucacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggcgaugcuuuucuugauaucaggcaaagggguuggaaagacuucaauaggacucauuuguguaguugcuuccagcggcauguuauggauggcugacaucccacuccaauggaucgcgucggccauaguucuggaguuuuuuaugauggugcuacuuauaccagaaccagaaaaacagagaacuccccaagacaaucaacucgcauaugucgugauaggcauacuuacauuggcugcaauaguagcagccaaugaaaugggauuguuggaaaccacaaagagagauuuggggauguccaaagaaccaggaguuguuccgccaaccagcuauuuggauguggauuugcacccagcaucagccuggacauuguaugcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacuggguugcuauucacaagugaacccacuaacucucacagcggcaguacuccugcuggucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguugaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguugaaaagaggagaaauaacacaccaugccguaucuagaggcagcgcaaaacuucaaugguucguggagagaaacauggucauuccugaaggaagggucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagagagcagaaccauaagagucuugaaaaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggccuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaagaauggccaucagcggggaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagacaugcuuacuguuuggaacaggguguggauagaggacaauccauggauggaagacaagacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggaguuagagggagccauuugguaa

SEQ ID NO: 7180 - RNA, 9873 nt, Artificial Sequence
  derived and/or modified CDS sequence (wt) from DENV-3__AB189127__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccaaaccuggaugucagcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagccacguggguugacguggugcucgaacacggugggugugugacuaccauggcuaagaacaagcccacgcuggacauagagcuccagaagaccgaggccacccaacuggcaacccuaaggaaacuaugcauugagggaaaaaucaccaacgugacaaccgacucaaggugccccacccaaggggaagcgauucuaccugaggagcaggaccagaacuacguguguaagcacacauauguggacagaggcuggggaaacgguugugguuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacaaugguuuuuugaccuaccucuaccauggacaucaggggcuacaacagaaacaccaaccuggaauaagaaagagcuucuugugacauucaaaaaugcacacgcaaaaaaacaagaaguaguaguccuuggaucgcaagagggagcaaugcacacagcacugacaggagcuacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaagguugaguacaaaggggaagacgcaccuugcaagauucccuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucgugcauugugauaggaaucaucacacucuaucugggagccguggugcaagcugacauggggugugucauaaacuggaaaggcaaagaacucaaauguggaaguggaauuuucguuacuaaugagguccacaccuggacagagcaauacaaauuucaagcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaguagugacagcugaaauacaaaauuccuccuuuauaauagaugggccaaacacaccagaguguccaaacgccucaagagcauggaacgugugggagguggaagauuacggguucggagucuucacaacuaauauaugguugaaacuccgagagauguacacccaacuaugugaccacaggcuaaugucggcagccguuaaggaugagagagccauacacgccgacaugggcuauuggauagaaagccaaaagaaugguaguuggaagcuagaaaaggcaucucucauagaggugaaaaccugcacauggccaaaaucacacacucucuggagcaaugguguguuggagagugacaugaucaucccaaagagucuggcugguccuaucucgcaacacaacuacaggcccggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguggauaacuucacaaugggugucuugugucuugcaauucucuuugaagagguaaugagaggaaaauucgggaaaaagcacaugauugcagggauucucuucauguuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuagucucccuaacguguucaaacacaauuuucacguugacuguugccuggagaacagccacccugauuuuggccggaauuucgcuuuugccagugugccagucuucgagcaugaggaaaacagauuggcucccaaugacuguggcagcuaugggaguuccaccucuaccacuuuuuauuuucaguuugaaagacacacucaaaaggagaagcuggccacugaaugagggggugauggccguuggacuugugagcauucuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggguguuggaguacaaaaagaaggaguuuuccacacuauguggcacgucacaagaggagcaguguugacauacaauggaaaaagacuggaaccaagcugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcauugaaagggcucccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacaccuccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccaugcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcucacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggcgaugcuuuucuugauaucaggcaaagggguuggaaagacuucaauaggacucauuuguguaguugcuuccagcggcauguuauggauggcugacaucccacuccaauggaucgcgucggccauaguucuggaguuuuuuaugauggugcuacuuauaccagaaccagaaaaacagagaacuccccaagacaaucaacucgcauaugucgugauaggcauacuuacauuggcugcaauaguagcagccaaugaaaugggauuguuggaaaccacaaagagagauuuggggauguccaaagaaccaggaguuguuccgccaaccagcuauuuggauguggauuugcacccagcaucagccuggacauuguaugcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacuggguugcuauucacaagugaacccacuaacucucacagcggcaguacuccugcuggucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguugaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguugaaaagaggagaaauaacacaccaugccguaucuagaggcagcgcaaaacuucaaugguucguggagagaaacauggucauuccugaaggaagggucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagagagcagaaccauaagagucuugaaaaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggccuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaagaauggccaucagcggggaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagacaugcuuacuguuuggaacaggguguggauagaggacaauccauggauggaagacaagacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggaguuagagggagccauuugguaa

SEQ ID NO: 7181 - RNA, 9873 nt, Artificial Sequence
  derived and/or modified CDS sequence (wt) from DENV-3__AB189128__SS-prME
acaucgcucugucucaugaugauauuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagagaugugugaugacacggucacuuacaaaugcccccucauuacugaaguggagccugaagacauugacuguuggugcaaccucacaucgacgugggugaccuauggaacgugcaaccaagcuggagagcacagacgcgauaagagaucgguggcguuagcuccccaugucggcaugggacuggacacacgcacccaaaccuggaugucggcugaaggagccuggagacaagucgagaagguagagacaugggccuuuaggcacccaggguuuacaguacuagcccuauuucuugcccauuucauaggcacuuccuugacccagaaaguggucauuuucauacuacuaaugcuggucaccccauccaugacaaugagaugugugggaguagggaacagagauuuuguggaaggccuaucaggagcuacguggguugacguggugcuugaacaugguggguguguaacuaccauggcuaagaacaagcccacgcuggacauagagcuccagaagaccgaagccacccaacuggcgacccuaaggaaacuaugcaucgagggaaaaaucaccaacguaacaaccgacucaaggugccccacccaaggagaagcgauuuuaccugaggaacaggaccagaacuacguguguaagcacacauacguggacagaggcuggggaaacgguugugguuuguuuggcaagggaagcuugguaacaugcgcgaaauuucaauguuuggaaucaauagagggaaaaguggugcagcaugagaaccucaaauacaccgucaucaucacagugcauacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacaaugguuuuuugaccuaccucuaccauggacaucaggggcuacaacagaaacaccaaccuggaauaagaaagagcuucuugugacauucaaaaacgcacaugcaaaaaaacaagaaguaguaguccuuggaucgcaagagggagcaaugcacacagcacugacaggagcuacagagauccaaaccucaggaggcacaaguauuuuugcggggcacuuaaaaugcagacucaagauggacaaauuggaacucaaggggaugagcuaugcaauguguuuaaaugccuuuguguugaagaaagaagucuccgaaacacaacaugggacaauacucauuaagguugaguacaaaggggaagaugcacccugcaagauuccuuucuccacggaggauggacaagggaaagcccacaauggcagacugaucacagccaacccaguggugaccaagaaggaggagccugucaauauugaggcagaaccuccuuuuggggaaaguaauauaguaauuggaauuggagacaaagccuugaaaaucaacugguauaagaagggaagcucgauugggaaaauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucuccuggauaaugaaaauuggaauagguguccuuuuaaccuggauaggguugaauucaaaaaacacuucuaugucauuuucaugcauugugauaggaaucaucacacucuaucugggagccguggugcaagcugacacgggguguguuauaaacuggaaaggcaaggaacucaaauguggaaguggaauuuucgucacuaaugaaguccacaccuggacagagcaauacaaauuucaagcagacucccccaaaagacuggcgacagccauugcaggugccugggagaauggagugugcggaaucaggucgacaacuagaauggagaaccucuuguggaagcaaauagccaaugaacugaacuacauauuaugggaaaacaacaucaaauuaacgguaguugugggugacauaauuggggucuuagagcaagggaaaagaacacuaacaccacaacccacggagcuaaaauauucauggaaaacauggggaaaggcgaaaauagugacagcugaaacacaaaauucuuccuucauaauagaugggccaaacacaccagaguguccaagugccucaagagcauggaaugugugggagguggaagaauacggguucggagucuucacaacuaauauauggcugaaacuccgagagauguacacccaacuaugugaccacaggcuaaugucggcagccguuaaggaugagagagccguacacgccgacaugggcuauuggauagaaagccaaaagaauggaaguuggaagcuagaaaaggcaucccucauagaggugaaaaccugcacauggccaaaaucacacacucucuggagcaacgguguccuagagagugacaugaucaucccgaagagucuggcuggucccauuucgcaacacaacuacaggcccggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaguugauacacgaaugguguugccgcucguguacacuuccuccccugcgauacaugggagaagacggcugcugguacgguauggaaauuagacccauuaaugagaaagaagagaacaugguaaagucuuuagucucagcagggaguggaaagguggauaacuucacaaugggugucuuguguuuggcaauccucuuugaagaggugaugagaggaaaauucggaaaaaagcacaugauugcaggaguucucuucacauuugugcuccuucucucagggcaaauaacauggagggacauggcgcguacacucauaaugauuggguccaacgccucugacagaaugggaaugggcgucacuuaccuagcauugauugcaacauuuaaaauucagccauuuuuggccuugggauucuuccugaggaaacugacaucuagagaaaauuuauuguugggaguugggcuggccauggcaacaacguuacaacugccagaggacauugaacaaauggcgaauggaauagcuuuggggcuuauggcucucaaauugauaacacaauuugaaacauaccaacuauggacggcauuagucucccuaauguguucaaacacaauuuucacguugacuguugccuggagaacagccacccugauuuuggccggaauuucgcuuuugccagugugccagucuucgagcaugaggaaaacagauuggcucccaaugacuguggcagcuaugggaguuccaccccuaccacuuuuuaucuucaguuuaaaagauacgcucaaaaggagaagcuggccacugaaugaggggguaauggccgucggacuugugagcauucuagcaaguucucuccuuaggaaugacguacccauggcuggaccauuaguggcugggggcuugcugauagcgugcuacgucauaacuggcacgucagcagaccucacuguagaaaaagcagcaaaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcaucuuuccauacuccauacccgcaacacuguuggucuggcacacuuggcaaaagcaaacccaaagauccggcguucuaugggacguccccagccccccagagacacagaaagcagaacuggaagauggggucuauaggaucaagcagcaaggaauuuuugggaagacccaaguggggguuggaguacaaaaagaaggaguuuuccacaccauguggcacgucacaagaggagcaguguugacacacaaugggaaaagacuggaaccaaacugggcuagcgugaaaaaagaucugaucucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuguauggcaauggaguggucacaaagaaugguggcuaugucaguggaauagcucaaacaaacgcagagccagauggaccgacaccagagcuggaagaagagauguucaaaaagcgaaaucuaaccauaauggaucuccaucccgggucaggaaagacgcggaaauaccuuccagcuauuguuagagaggcaaucaagagacgcuuaaggacucuaauuuuggcaccaacaagggugguugcagcugagauggaagaagcauugaaagggcucccaauaagguaucaaacgacugcaacaaaaucugaacacacagggaaagagauuguugaucuaaugugucacgcaacguucacaaugcguuugcugucaccagucagaguuccaaacuauaacuugauaauaauggaugaggcucauuucacagauccagccaguauagcggcuagaggguacauaucaacucguguaggaaugggagaggcagccgcaauuuucaugacagccacacccccugguacagcugaugccuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaagacuaaauuaaaugauugggacuuuguggugacaacagacauuucagaaaugggagccaauuucaaagcagacagagugaucgacccaagaagaugucucaagccagucauuuugacagacggaccugagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcaaaaaugcugcuagacaacaucaacacaccagaagggaucauaccagcucucuuugaaccagaaagggagaagucugccgccauagacggcgaauaccgccugaaaggugaaucuaggaagaccuucguggaacucaugaggaggggugaccucccagucuggcuagcccauaaaguagcgucagaaggaaucaaauauacagacagaaaaugguguuuugauggagaacgcaacaaucaaauuuuagaggagaacauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagaacacggugggagggccuacaggcaugcaguggaggaauuaccagaaacaauggaaacacucuuacuccugggacucaugauccuauuaacagguggggcaaugcuuuucuugauaucagguaaagggauuggaaagacuucaauaggacucauuugugugguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuaggaauguccaaagaaccagguguugucucuccaaucagcuauuuggauguggauuugcacccagcaucagccuggacauuguaugcuguggccacaacaguaauaacaccaauguugagacauaccauagagaauuccacagcaaaugugucccuggcggcuauagccaaccaggcagugguccugauggguuuagacaaaggauggccgauaucgaaaauggacuuaggcguaccacuauuagcacugggcugcuauucacaagugaacccacuaacucucacagcggcaguacuccugcuagucacgcacuacgcuauuauagguccaggauugcaggcaaaagccacucgugaagcucaaaaaaggacagcugcuggaauaaugaagaauccaacgguggaugggauaaugacaauagaccuagauccuguaauauacgauucaaaauuugaaaagcaacuaggacagguuaugcuccugauuuugugugcaguucaacucuuguuaaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagcgaggaacagggucacaaggugaaaccuugggagaaaaguggaaaaagaaauugaaucaauuaucccggaaagaguuugaccuuuacaagaaauccggaaucacugaaguggauagaacagaagccaaagagggguugaaaagaggagaaauaacacaccaugccguguccagaggcagcgcaaaacuucaaugguucguggagaggaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguacugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagacguggauuuaggagcggggacccgacauguaaaugcggaaccagaaacacccaacauggaugucauuggggaaagaauaagaaggaucaaggaggagcauaguucaacguggcacuaugaugaugaaaauccuuauaaaacgugggcuuaccauggauccuaugaaguuaaggccacaggcucagccuccucuaugauaaauggagucgugaaacuccucacgaaaccaugggauguggugcccacggugacacagauggcaaugacggacacaaccccuuucggccagcaaaggguuuuuaaagagaaaguggacaccaggacacccagacccaugccaggaacaagaaagguuauggagaucacagcggaauggcuuuggagaacccugggaaggaauaaaagacccagauuaugcacgagagaggaguucacaaaaaaggucagaaccaacgcagcuaugggcgccguauucacagaggagaaccaaugggacagugcuagagcugcuguugaagaugaagaauucuggaaacucguggacagagaacgugaacuccacaaacugggcaaguguggaagcugcguuuacaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuauaguggaguagaaggggaaggacugcauaagcugggauauaucuugagagauauuuccaagauacccggaggagcuauguaugcugaugacacagcugguugggauacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaaggggcaguggacaggugggaacuuauggucugaacacauucaccaacauggaagcccaguuaaucagacaaauggaaggagaagguguguugucgaaggcagaccucgagaacccccaucugcuagagaagaaaauuacacaaugguuggaagcugaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucgaagggauggcaugauuggcaacaggucccuuucugcucccaccacuuucaugaauugaucaugaaagauggaagaaaguugguaguccccugcagaccccaggaugaauuaauagggagagcgagaaucucucaaggggcaggauggagccuuaaagaaacugcaugccuagggaaagccuacgcccaaaugugggcucucauguauuuucacagaagagaucuuagacuggcauccaacgccauauguucagcaguaccaguccauuggguccccacaagcaggacgacgugguccauucaugcucaccaucaguggaugacuacagaagacaugcuuacuguuuggaacaggguguggauagaggauaauccauggauggaagacaaaacuccagucacaacuugggaagauguaccauaucuagggaagagagaagaccaauggugcggaucacucauaggucacacuuccagagcaaccugggcccagaacauacuuaccgcaauccaacagguaagaagccuuauaggcaaugaagaguuucuggacuacaugccuucgaugaagagauuuaggaaggaggaggagucagagggagccauuugguaa

SEQ ID NO: 7182 - RNA, 9873 nt, Artificial Sequence
  derived and/or modified CDS sequence (wt) from DENV-3__AB214879__SS-prME
acaucgcucugucucaugaugauguuaccagcaacacuugcuuuccacuugacuucacgagauggagagccgcgcaugauuguggggaagaaugaaagaggaaaaucccugcuuuucaagacagccucuggaaucaacaugugcacacucauagccauggauuugggagaaaugugugaugacacggucacuuacaaaugcccccucauuacugaaguggagccugaggacauugacugcuggugcaaccucacaucgacgugggugaccuacggaacgugcaaccaagcuggagagcauagacgcgauaaaagaucgguggcguuagcuccccauguuggcaugggacuggacacacgcacccaaaccuggaugucggcugaaggagcuuggagacaagucgagaagguagagacaugggccuuuaggcacccaggguucacaauacuagcccuauuucuugcccauuacauagggacuuccuugacccagaaaguggucauuuucauacuguuaauguuggucacuccauccaugacaaugagaugugugggaguaggaaacagagauuuuguggaaggccuaucaggagcuacguggguugacguggugcucgaacacggugggugugugacuaccauggcuaagaacaagcccacgcuggauauagagcuccagaagaccgaggccacccaacuagcaacccuaaggaaacuaugcauugagggaaaaaucaccaacgugacaaccgacucaaggugccccacccaaggggaagcgauuuuaccugaggagcaggaccagaacuacguguguaagcacacauacguggacagaggcuggggaaacgguuguggcuuguuuggcaagggaagcuugguaacaugcgcgaaauuucaauguuuggaaucaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccgucuuaccugaauauggaacccuugggcuagaaugcucaccacgaacagguuuggacuuuaaugaaaugauuuuguugacaaugaagaacaaagcauggaugguacacagacaaugguuuuuugaccuaccucuaccauggacaucaggggcuacaacagaaacaccaaccuggaauaagaaagagcuucuugugacauucaaaaacgcacacgcaaaaaaacaagaaguagugguccuuggaucgcaagagggagcaaugcacacagcacugacaggagcuacagagauccaaaccucaggaggcacaaguguuuuugcggggcacuuaaaaugcagacucaagauggacaaauuggaacucaaggggaugagcuaugcaaugugcucaaaugccuuuguguugaagaaagaagucucugaaacacagcauggaacaauacucauaaaggucgaguacaaaggggaagaugcaccuugcaagauuccuuucuccacggaggauggacaagggaaagcccacaauggcagacugaucacagccaacccaguggugaccaagaaggaagagccugucaauauugaggcagaaccuccuuuuggggaaaguaacauaauaauuggaauuggggacaaagccuugaaaaucaauugguacaagaagggaagcucgauugggaagauguucgaggccacugccagaggugcaaggcgcauggccaucuugggagacacagccugggacuucggaucaguaggugguguuuuaaauucauuggggaaaauggugcaccaaauauuuggaagcgcuuacacggcccuuuuuaguggagucuccuggauaaugaaaauuggaauagguguccuuuuaacuuggauaggguugaauucaaaaaacacuucuaugucauuuucaugcauugugauuggaaucaucacacucuaucugggagcuguggugcaagcugacauggggugugucauaaacuggaaaggcaaagaacuuaaauguggaaguggaauuuucguuacuaaugagguccacaccuggacagagcaauacaaauuucaagcagacuccccaaaaagacuggcgacagccauugcaggcgccugggagaauggaguguguggaaucaggucgacaaccagaauggagaaccucuuguggaagcaaauagccaaugaacuaaacuacauauuaugggaaaacaacauuaaauuaacgguaguugugggugauauaauuggggucuuagagcaagggaaaagaacacuaacaccacaacccauggagcuaaaauauucauggaaaacauggggaaaggcgaaaauagugacagcugaaacacaaaauucuuccuucauaauagaugggcccaacacaccagaguguccaagugccucgagagcauggaaugugugggagguggaagauuacggguucggaguuuucacaaccaauauauggcugaaacuccgagagauguacacccaacuaugugaccacaggcuaaugucggcagccguuaaggaugagagagccguacacgccgacaugggcuauuggauagaaagccaaaagaauggaaguuggaagcuagaaaaggcaucucucauagaggugaaaaccugcacauggccaaagucacacacucucuggagcaaugguguguuggagagugauaugaucaucccaaagagucuagcugguccuaucucgcaacacaacuacaggcccggauaccacacccaaacggcaggacccuggcaccuaggaaaacuggagcuggacuuuaacuauugugagggaacaacaguugucaucacagaaaauugugggacaagaggcccaucacugaggacaacaacagugucagggaaauugauacacgaaugguguugccgcucgugcacacuuccuccucugcgauacaugggagaagacggcugcugguauggcauggaaauuagacccauuaaugagaaagaagagaauaugguaaagucuuuagucucagcagggaguggaaagguggacaacuucacaaugggugucuuguguuuggcaauccucuuugaagagguaaugagaggaaaauucggaaaaaagcacaugauugcaggaguucucuucacauuugugcuccuucucucugggcaaauaacauggagagacauggcgcguacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguuggguuggccauggcaacaacguugcaacugccagaggacauugaacaaauggcgaauggaauagccuuggggcucauggcucuuaaauugauaacacaauucgaaacauaccaacuguggacggcauuaaccucccuaauguguucaaacacaauuuucacguugacuguugccuggagaacagccacccugauuuuggccggaauuucgcuuuugccagugugccagucuucgagcaugaggaaaacagauuggcugccaaugacuguggcagcuaugggaguuccaccucuaccacuuuuuaucuucaguuugaaagacacacucaaaaggagaagcuggccacugaaugagggggugauggccguuggacuugugagcauuuuggcaagcucucuccuuaggaaugacguacccauggcuggaccauuaguggcugggggcuugcugauagcgugcuacgucauaacuggcacgucagcagaccuuacuguagaaaaagcagcagaugugacaugggaggaagaggcugagcaaacaggagugucccacaaucuaaugaucacaguugaugaugauggaacaaugagaauaaaagaugaugagacugagaacaucuuaacagugcuuuugaaaacagcauuacuaauagugucaggcauuuuuccauacuccauacccgcaacacuguuggucuggcauacuuggcaaaagcaaacccaaagauccggcguccuaugggacguaccuagccccccagagacacagaaagcagaacuggaagaaggggucuauaggaucaagcagcaaggaauuuuugggaagacccaaguggggguuggaguacaaaaagaaggaguuuuccacaccauguggcacgucacaagaggagcaguguugacacacaaugggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacgacaggggagauaggagcgauugcacuggacuucaagccuggaacuucaggaucucccaucauaaacagagagggaaagguagugggacuguauggcaauggaguggucacaaagagugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagccauaguuagagaggcaaucaagagacgcuuaaggacccuaauuuuggcaccaacaagggugguugcagcugagauggaagaagcauugaaagggcucccaauaagguaucaaacaacugcaacaaaauccgaacacacagggaaagagauuguugaucuaaugugucaugcaacguucacaaugcguuugcugucaccagucagaguuccaaacuacaacuugauaauaauggaugaggcucauuucacagacccagccaguauagcggcuagaggguacauaucaacucgugugggaaugggagaggcagccgcaauuuucaugacagccacacccccuggaacagcugaugccuuuccucagagcaacgcuccaauucaagaugaagaaagagacaucccagaacgcucauggaauucaggcaaugauuggauuaccgacuuugccgggaagacugugugguuuguccccagcaucaaagcuggaaaugacauagcaaacugcuugcgaaaaaauggaaaaaaggucauucaacuuaguaggaaaacuuuugacacagaauaucaaaagacuaaacuaaaugauugggacuuuguggugacaacagacauuucggaaaugggagccaauuucaaagcagacagagugaucgacccaagaagaugucucaagccagucauuuugacagacggacccgagcgugugauccuggcaggaccaaugccagucaccguagcgagugcugcacaaaggagagggagaguuggcaggaacccacaaaaagaaaaugaccaauacauauucacgggccagccccucaacaaugaugaagaccacgcucacuggacagaagcaaaaaugcugcuagacaacauuaacacaccagaagggaucauaccagcucucuuugaaccagaaagggagaagucagccgccauagacggcgaauaccgccugaaaggugagucccggaagacuuucguggaacucaugaggaggggugaccucccaguuuggcuagcccauaaaguagcaucagaaggaaucaaauacacagauagaaaaugguguuuugauggagagcgcaacaaucaaauuuuagaggagaauauggauguggaaauuuggacaaaggaaggagaaaagaaaaaauugaggccuagguggcuugacgcccgcacuuauucagaucccuuagcgcucaaggaauucaaggacuuugcggcugguagaaagucgaucgccuuugaucuuguaacagaaauaggaagagugccuucacauuuagcccacagaacgagaaaugcucuggacaauuugguaauguugcacacgucagaacacggugggagggccuacaggcaugcaguggaggaauuaccagaaacaauggaaacacucuuacuccugggacucaugauccuguuaacagguggggcaaugcuuuucuugauaucaggcaaagggauuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagauaaucaacucgcauaugucgugauaggcauacuuacauuggcugcaauaguagcagccaaugaaaugggauuguuggaaaccacaaagagagauuuggggauguccaaagaaccagguguuguuucuccaaccagcuauuuggauguggauuugcacccagcaucagcuuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggauuuaggcguaccacuauuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaacccaacgguggaugggauaaugacaauagaccuagauccuguaauauacgauucaaaauuugaaaaacaacuaggacaaguuaugcuccugguucugugugcaguucaacucuuguuaaugagaacaucaugggcauuuugugaagcucuaacccuagccacaggaccaauaacaacacucugggaaggaucaccagggaaguucuggaacaccacgauagcuguuuccauggcgaacaucuuuagagggagcuauuuagcaggagcugggcucgcuuuuucuaucaugaaaucaguuggaacaggaaagagaggaacagggucacaaggugaaacuuugggagaaaaguggaaaaagaaauugaaucaauugucccggaaagaguuugaccuuuacaagaaauccggaaucacugaaguggauagaacagaagcuaaagaaggguugaaaagaggagaaauaacacaccaugccguauccagaggcagcgcaaaacuucaaugguucguggagagaaacauggucaucccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcuaaugaguggaaaggauguguuuuaucuuccaccugaaaagugugacacucuauugugugacauuggagagucuucaccaagcccaacaguggaagagagcagaaccauaagagucuugaaaaugguugaaccauggcuaaaaaacaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacuacuacugaacagauucacaaugacauauaggagacccaccauagagaaagauguggauuuaggagcggggacccgacaugucaaugcggaaccagaaacaccuaacauggaugucauuggggaaagaauaaggaggauuaaggaggagcauaguucaacauggcacuaugaugaugaaaauccuuacaaaacgugggcuuaccauggaucuuaugaaguuaaggccacagguucagccuccuccaugauaaauggagucguaaaacuccucacgaaaccaugggauguggugcccacggugacacagauggcaaugacggacacaacccccuuuggccagcaaaggguuuuuaaagagaaaguggacaccaggacacccaaacccaugccaggaacaagaaaggucauggagaucacagcagaauggcucuggagaacccugggaaggaauaaaagacccagauuaugcacgagagaggaguucacaaaaaaggucagaaccaacgcagcuaugggcgccguauucacagaggagaaccaaugggacagugccagagcugccguugaagaugaagaauucuggaaacucguggacagagaacgugagcuccacaaacugggcaaguguggaagcugcguuuauaacaugaugggcaagagagagaagaaacuuggagaguuuggcaaagcaaaaggcaguagagccauaugguacauguggcugggagccagguaccuugaguucgaggcacucggauucuuaaaugaagaccauugguucucgcgcgaaaacucuuacaguggaguagaaggggaaggacugcauaagcugggauacaucuugagagacauuuccaagauaccaggaggagccauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugauuagacaaauggaaggagaagguguguugucgaagacagaccucgagaacccucaucugcuagagaagagaauuacacaaugguuggaaaccaaaggaguggagagguuaaaaagaauggccaucagcggggacgauugcguggugaaaccaaucgaugacagguucgccaaugcccugcuugcccugaaugacaugggaaaaguuaggaaggacauaccucaauggcaaccaucgaagggauggcaugauuggcaacaggucccuuucugcucccaccacuuucaugaauugauuaugaaagauggaagaaaguugguaguccccugcagaccucaggaugaauuaauagggagagcgagaaucucucaaggagcaggauggagccuuaaagaaacugcaugccuagggaaagccuacgcccaaaugugggcucucauguauuuucacagaagagaucuuagacuagccuccaacgccauauguucagcaguaccaguccauuggguccccacaagcagaacgacuugguccauccaugcucaccaucaguggaugacuacagaagauaugcuuacuguuuggaacaggguguggauagaggacaauccauggauggaagauaaaacuccaguuacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7183 - RNA, 9873 nt, Artificial Sequence
  derived and/or modified CDS sequence (wt) from DENV-3__AB214880__SS-prME
acaucgcucugucucaugaugauguuaccagcaacacuugcuuuccacuugacuucacgagauggagagccgcgcaugauuguggggaagaaugaaagaggaaaaucccugcuuuucaagacagccucuggaaucaacaugugcacacucauagccauggauuugggagaaaugugugaugacacggucacuuacaaaugcccccucauuacugaaguggagccugaggacauugacugcuggugcaaccucacaucgacgugggugaccuacggaacgugcaaccaagcuggagagcauagacgcgauaaaagaucgguggcguuagcuccccauguuggcaugggacuggacacacgcacccaaaccuggaugucggcugaaggagcuuggagacaagucgagaagguagagacaugggccuuuaggcacccaggguucacaauacuagcccuauuucuugcccauuacauagggacuuccuugacccagaaaguggucauuuucauacuguuaauguuggucacuccauccaugacaaugagaugugugggaguaggaaacagagauuuuguggaaggccuaucaggagcuacguggguugacguggugcucgaacacggugggugugugacuaccauggcuaagaacaagcccacgcuggauauagagcuccagaagaccgaggccacccaacuagcaacccuaaggaaacuaugcauugagggaaaaaucaccaacgugacaaccgacucaaggugccccacccaaggggaagcgauuuuaccugaggagcaggaccagaacuacguguguaagcacacauacguggacagaggcuggggaaacgguuguggcuuguuuggcaagggaagcuugguaacaugcgcgaaauuucaauguuuggaaucaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccgucuuaccugaauauggaacccuugggcuagaaugcucaccacggacagguuuggacuuuaaugaaaugauuuuguugacaaugaagaacaaagcauggaugguacacagacaaugguuuuuugaccuaccucuaccauggacaucaggggcuacaacagaaacaccaaccuggaauaagaaagagcuucuugugacauucaaaaacgcacacgcaaaaaaacaagaaguagugguccuuggaucgcaagagggagcaaugcacacagcacugacaggagcuacagagauccaaaccucaggaggcacaaguauuuuugcggggcacuuaaaaugcagacucaagauggacaaauuggaacucaaggggaugagcuaugcaaugugcucaaaugccuuuguguugaagaaagaagucucugaaacacagcauggaacaauacucauaaaggucgaguacaaaggggaagaugcaccuugcaagauuccuuucuccacggaggauggacaagggaaagcccacaauggcagacugaucacagccaacccaguggugaccaagaaggaggagccugucaauauugaggcagaacccccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucauuggggaaaauggugcaccaaauauuuggaagcgcuuacacggcccuuuuuaguggagucuccuggauaaugaaaauuggaauagguguccuuuuaacuuggauaggguugaauucaaaaaacacuucuaugucauuuucaugcauugugauuggaaucaucacacucuaucugggagcuguggugcaagcugacauggggugugucauaaacuggaaaggcaaagaacuuaaauguggaaguggaauuuucguuacuaaugagguccacaccuggacagagcaauacaaauuucaagcagacuccccaaaaagacuggcgacagccauugcaggcgccugggagaauggaguguguggaaucaggucgacaaccagaauggagaaccucuuguggaagcaaauagccaaugaacuaaacuacauauuaugggaaaacaacauuaaauuaacgguaguugugggugauauaauuggggucuuagagcaagggaaaagaacacuaacaccacaacccauggagcuaaaauauucauggaaaacauggggaaaggcgaaaauagugacagcugaaacacaaaauucuuccuucauaauagaugggcccaacacaccagaguguccaagugccucgagagcauggaaugugugggagguggaagauuacggguucggaguuuucacaaccaauauauggcugaaacuccgagagauguacacccaacuaugugaccacaggcuaaugucggcagccguuaaggaugagagagccguacacgccgacaugggcuauuggauagaaagccaaaagaauggaaguuggaagcuagaaaaggcaucucucauagaggugaaaaccugcacauggccaaagucacacacucucuggagcaaugguguguuggagagugauaugaucaucccaaagagucuagcugguccuaucucgcaacacaacuacaggcccggauaccacacccaaacggcaggacccuggcaccuaggaaaauuggagcuggacuuuaacuauugugagggaacaacaguugucaucacagaaaauugugggacaagaggcccaucacugaggacaacaacagugucagggaaauugauacacgaaugguguugccgcucgugcacacuuccuccucugcgauacaugggagaagacggcugcugguauggcauggaaauuagacccauuaaugagaaagaagagaauaugguaaagucuuuagucucagcagggaguggaaagguggacaacuucacaaugggugucuuguguuuggcaauccucuuugaagagguaaugagaggaaaauucggaaaaaagcacaugauugcagggguucucuucacauuugugcuccuucucucugggcaaauaacauggagagacauggcgcguacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguuggguuggccauggcaacaacguugcaacugccagaggacauugaacaaauggcgaauggaauagccuuggggcucauggcucuuaaauugauaacacaauucgaaacauaccaacuguggacggcauuagccucccuaauguguucaaacacaauuuucacguugacuguugccuggagaacagccacccugauuuuggccggaauuucgcuuuugccagugugccagucuucgagcaugaggaaaacagauuggcugccaaugacuguggcagcuaugggaguuccaccucuaccacuuuuuaucuucaguuugaaagacacacucaaaaggagaagcuggccacugaaugagggggugauggccguuggacuugugagcauuuuggcaagcucucuccuuaggaaugacguacccauggcuggaccauuaguggcugggggcuugcugauagcgugcuacgucauaacuggcacgucagcagaccuuacuguagaaaaagcagcagaugugacaugggaggaagaggcugagcaaacaggagugucccacaaucuaaugaucacaguugaugaugauggaacaaugagaauaaaagaugaugagacugagaacaucuuaacagugcuuuugaaaacagcauuacuaauagugucaggcauuuuuccauacuccauacccgcaacacuguuggucuggcauacuuggcaaaagcaaacccaaagauccggcguccuaugggacguaccuagccccccagagacacagaaagcagaacuggaagaaggggucuauaggaucaagcagcaaggaauuuuugggaagacccaaguggggguuggaguacaaaaagaaggaguuuuccacaccauguggcacgucacaagaggagcaguguugacacacaaugggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacgacaggggagauaggagcgauugcacuggacuucaagccuggaacaucaggaucucccaucauaaacagagagggaaagguagugggacuguauggcaauggaguggucacaaagagugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagccauaguuagagaggcaaucaagagacgcuuaaggacccuaauuuuggcaccaacaagggugguugcagcugagauggaagaagcauugaaagggcucccaauaagguaucaaacaacugcaacaaaauccgaacacacagggaaagagauuguugaucuaaugugucaugcaacguucacaaugcguuugcugucaccagucagaguuccaaacuacaacuugauaauaauggaugaggcucauuucacagacccagccaguauagcggcuagaggguacauaucaacucgugugggaaugggagaggcagccgcaauuuucaugacagccacacccccuggaacagcugaugccuuuccucagagcaacgcuccaauucaagaugaagaaagagacaucccagaacgcucauggaauucaggcaaugauuggauuaccgacuuugccgggaagacugugugguuuguccccagcaucaaagcuggaaaugacauagcaaacugcuugcgaaaaaauggaaaaaaggucauucaacuuaguaggaaaacuuuugacacagaauaucaaaagacuaaacuaaaugauugggacuuuguggugacaacagacauuucggaaaugggagccaauuucaaagcagacagagugaucgacccaagaagaugucucaagccagucauuuugacagacggacccgagcgugugauccuggcaggaccaaugccagucaccguagcgagugcugcacaaaggagagggagaguuggcaggaacccacaaaaagaaaaugaccaauacauauucacgggccagccccuuaacaaugaugaagaccacgcucacuggacagaagcaaaaaugcugcuagacaacauuaacacaccagaagggaucauaccagcucucuuugaaccagaaagggagaagucagccgccauagacggcgaauaccgccugaaaggugagucccggaagacuuucguggaacucaugaggaggggugaccucccaguuuggcuagcccauaaaguagcaucagaaggaaucaaauacacagauagaaaaugguguuuugauggagagcgcaacaaucaaauuuuagaggagaauauggauguggaaauuuggacaaaggaaggagaaaagaaaaaauugaggccuagguggcuugacgcccgcacuuauucagaucccuuagcgcucaaggaauucaaggacuuugcggcugguagaaagucgaucgccuuugaucuuguaacagaaauaggaagagugccuucacauuuagcccacagaacgagaaaugcucuggacaauuugguaauguugcacacgucagaacacggugggagggccuacaggcaugcaguggaggaauuaccagaaacaauggaaacacucuuacuccugggacucaugauccuguuaacagguggggcaaugcuuuucuugauaucaggcaaagggauuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagauaaucaacucgcauaugucgugauaggcauacuuacauuggcugcaauaguagcagccaaugaaaugggauuguuggaaaccacaaagagagauuuggggauguccaaagaaccagguguuguuucuccaaccagcuauuuggauguggauuugcacccagcaucagcuuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggauuuaggcguaccacuacuggcacuggguugcuauucacaagugaacccacuaacucucacagcggcaguacuccugcuagucacgcauuaugccauuauagguccaggauugcaggcaaaagccacucgugaagcucaaaaaaggacggcugcuggaauaaugaagaacccaacgguggaugggauaaugacaauagaccuagauccuguaauauacgauucaaaauuugaaaaacaacuaggacaaguuaugcuccugguucugugugcaguucaacucuuguuaaugagaacaucaugggcauuuugugaagcucuaacccuagccacaggaccaauaacaacacucugggaaggaucaccagggaaguucuggaacacuacgauagcuguuuccauggcgaacaucuuuagagggagcuauuuagcaggagcugggcucgcuuuuucuaucaugaaaucaguuggaacaggaaagagaggaacagggucacaaggugaaacuuugggagaaaaguggaaaaagaaauugaaucaauugucccggaaagaguuugaccuuuacaagaaauccggaaucacugaaguggauagaacagaagcuaaagaaggguugaaaagaggagaaauaacacaccaugccguauccagaggcagcgcaaaacuucaaugguucguggagagaaacauggucaucccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcuaaugaguggaaaggauguguuuuaucuuccaccugaaaagugugacacucuauugugugacauuggagagucuucaccaagcccaacaguggaagagagcagaaccauaagagucuugaaaaugguugaaccauggcuaaaaaacaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacuacuacugaacagauucacaaugacauauaggagacccaccauagagaaagauguggauuuaggagcggggacccgacaugucaaugcggaaccagaaacaccuaacauggaugucauuggggaaagaauaaggaggauuaaggaggagcauaguucaacauggcacuaugaugaugaaaauccuuacaaaacgugggcuuaccauggaucuuaugaaguuaaggccacagguucagccuccuccaugauaaauggagucguaaaacuccucacgaaaccaugggauguggugcccacggugacacagauggcaaugacggacacaacccccuuuggccagcaaaggguuuuuaaagagaaaguggacaccaggacacccaaacccaugccaggaacaagaaaggucauggagaucacagcagaauggcucuggagaacccugggaaggaauaaaagacccagauuaugcacgagagaggaguucacaaaaaaggucagaaccaacgcagcuaugggcgccguauucacagaggagaaccaaugggacagugccagagcugccguugaagaugaagaauucuggaaacucguggacagagaacgugagcuccacaaacugggcaaguguggaagcugcguuuauaacaugaugggcaagagagagaagaaacuuggagaguuuggcaaagcaaaaggcaguagagccauaugguacauguggcugggagccagguaccuugaguucgaggcacucggauucuuaaaugaagaccauugguucucgcgugaaaacucuuacaguggaguagaaggggaaggacugcauaagcugggauacaucuugagagacauuuccaagauaccaggaggagccauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugauuagacaaauggaaggagaagguguguugucgaagacagaccucgagaacccucaucugcuagagaagagaauuacacaaugguuggaaaccaaaggaguggagagguuaaaaagaauggccaucagcggggacgauugcguggugaaaccaaucgaugacagguucgccaaugcccugcuugcccugaaugacaugggaaaaguuaggaaggacauaccucaauggcaaccaucgaagggauggcaugauuggcaacaggucccuuucugcucccaccacuuucaugaauugauuaugaaagauggaagaaaguugguaguccccugcagaccucaggaugaauuaauagggagagcgagaaucucucaaggagcaggauggagccuuaaagaaacugcaugccuagggaaagccuacgcccaaaugugggcucucauguauuuucacagaagagaucuuagacuagccuccaacgccauauguucagcaguaccaguccauuggguccccacaagcagaacgacuugguccauccaugcucaccaucaguggaugacuacagaagauaugcuuacuguuuggaacaggguguggauagaggacaauccauggauggaagacaaaacuccaguuacaacuugggaagauguuccauaucuagggaagagagaagaccaauggugcggaucacucauuggucucacuuccagagcaaccugggcccagaacauacuuaccgcaauccaacaaguaagaagccuuauaggcaaugaagaguuucuggacuacaugccuucgaugaagagauucaggaaggaggaggagucagagggagccauuugguaa

SEQ ID NO: 7184 - RNA, 9873 nt, Artificial Sequence
  derived and/or modified CDS sequence (wt) from DENV-3__AB214881__SS-prME
acaucgcucugucucaugaugauguuaccagcaacacuugcuuuccacuugacuucacgagauggagagccgcgcaugauuguggggaagaaugaaagaggaaaaucccugcuuuucaagacagccucuggaaucaacaugugcacacucauagccauggauuugggagaaaugugugaugacacggucacuuacaaaugcccccucaucacugaaguggagccugaggacauugacugcuggugcaaccucacaucgacgugggugaccuacggaacgugcaaccaagcuggagagcauagacgcgauaaaagaucgguggcguuagcuccccauguuggcaugggacuggacacacgcacccaaaccuggaugucggcugaaggagcuuggagacaagucgagaagguagagacaugggccuuuaggcacccaggguucacaauacuagcccuauuucuugcccauuacauagggacuuccuugacccagaaaguggucauuuucauacugcuaauguuggucacuccauccaugacaaugagaugugugggaguaggaaacagagauuuuguggaaggccuaucaggagcuacguggguugacguggugcucgaacacggugggugugugacuaccauggcuaagaacaagcccacgcuggauauagagcuccagaagaccgaggccacccaacuagcaacccuaaggaaacuaugcauugagggaaaaaucaccaacgugacaacugacucaaggugccccacccaaggggaagcgauuuuaccugaggagcaggaccagaacuacguguguaagcacacauacguggacagaggcuggggaaacgguuguggcuuguuuggcaagggaagcuugguaacaugcgcgaaauuucaauguuuggaaucaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccgucuuaccugaauauggaacccuugggcuagaaugcucaccacggacagguuuggacuuuaaugaaaugauuuuguugacaaugaagaacaaagcauggaugguacacagacaaugguuuuuugaccuaccucuaccauggacaucaggggccacaacagaaacaccaaccuggaauaagaaagagcuucuugugacauucaaaaacgcacacgcaaaaaaacaagaaguagugguccuuggaucgcaagagggagcaaugcacacagcacugacaggagcuacagagauccaaaccucaggaggcacaaguauuuuugcggggcacuuaaaaugcagacucaagauggacaaauuggaacucaaggggaugagcuaugcaaugugcucaaaugccuuuguguugaagaaagaagucucugaaacacagcauggaacaauacucauaaaggucgaguacaaaggggaagaugcacccugcaagauuccuuucuccacggaggauggacaagggaaagcccacaauggcagacugaucacagccaacccaguggugaccaagaaggaagagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucauuggggaaaauggugcaccaaauauuuggaagcgcuuacacggcccuuuuuaguggagucuccuggauaaugaaaauuggaauagguguccuuuuaacuuggauaggguugaauucaaaaaacacuucuaugucauuuucaugcauugugauuggaaucaucacacucuaucugggagcuguggugcaagcugacauggggugugucauaaacuggaaaggcaaagaacuuaaauguggaaguggaauuuucguuacuaaugagguccacaccuggacagagcaauacaaauuucaagcagacuccccaaaaagacuggcgacagccauugcaggcgccugggagaauggaguguguggaaucaggucgacaaccagaauggagaaccucuuguggaagcaaauagccaaugaacuaaacuacauauuaugggaaaacaacaucaaauuaacgguaguugugggugauauaauugggaucuuagagcaagggaaaagaacacuaacaccacaacccauggagcuaaaauauucauggaaaacauggggaaaggcgaaaauagugacagcugaaacacaaaauucuuccuucauaauagaugggcccaacacaccagaguguccaagugccucgagagcauggaaugugugggagguggaagauuacggguucggaguuuucacaaccaauauauggcugaaacuccgagagauguacacccaacuaugugaccacaggcuaaugucggcagcuguuaaggaugagagagccguacacgccgacaugggcuauuggauagaaagccaaaagaauggaaguuggaagcuagaaaaggcaucucucauagaggugaaaaccugcacauggccaaagucacacacucucuggagcaaugguguguuggagagugauaugaucaucccaaagagucuggcugguccuaucucgcaacacaacuacaggcccggauaccacacccaaacggcaggacccuggcaccuaggaaaauuggagcuggacuuuaacuauugugagggaacaacaguugucaucacagaaaauugugggacaagaggcccaucacugaggaccacaacagugucagggaaauugauacacgaaugguguugccgcucgugcacacuuccuccucugcgauacaugggagaagacggcugcugguauggcauggaaauuagacccauuaaugagaaagaagagaauaugguaaagucuuuagucucagcagggaguggaaagguggacaacuucacaaugggugucuuguguuuggcaauccucuuugaagagguaaugagaggaaaauucggaaaaaagcacaugauugcagggguucucuucacauuugugcuccuucucuccgggcaaauaacauggagagacauggcgcguacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguuggguuggccauggcaacaacguugcaacugccagaggacauugaacaaauggcgaauggaauagccuuggggcucauggcucuuaaauugauaacacaauucgaaacauaccaauuguggacggcauuagccucccuaauguguucaaacacaauuuucacguugacuguugccuggagaacagccacccugauuuuggccggaauuucgcuuuugccagugugccagucuucgagcaugaggaaaacagauuggcuaccaaugacuguggcagcuaugggaguuccaccucuaccacuuuuuaucuucaguuugaaagacacacucaaaaggagaagcuggccacugaaugagggggugauggccguuggacuugugagcauuuuggcaagcucucuccuuaggaaugacguacccauggcuggaccauuaguggcugggggcuugcugauagcgugcuacgucauaacuggcacgucagcagaccuuacuguagaaaaagcagcagaugugacaugggaggaagaggcugagcaaacaggagugucccacaaucuaaugaucacaguugaugaugauggaacaaugagaauaaaagaugaugagacugagaacaucuuaacagugcuuuugaaaacagcauuacuaauagugucaggcauuuuuccauacuccauacccgcaacacuguuggucuggcauacuuggcaaaagcaaacccaaagauccggcguccuaugggacguaccuagccccccagagacacagaaagcagaacuggaagaaggggucuauaggaucaagcagcaaggaauuuuugggaagacccaaguggggguuggaguacaaaaagaaggaguuuuccacaccauguggcacgucacaagaggagcaguguugacacacaaugggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacgacaggggagauaggagcgauugcacuggacuucaagccuggaacuucaggaucucccaucauaaacagagagggaaagguagugggacuguauggcaauggaguggucacaaagagugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagccauaguuagagaggcaaucaagagacgcuuaaggacccuaauuuuggcaccaacaagggugguugcagcugagauggaagaagcauugaaagggcucccaauaagguaucaaacaacugcaacaaaauccgaacacacagggaaagagauuguugaucuaaugugucaugcaacguucacaaugcguuugcugucaccagucagaguuccaaacuacaacuugauaauaauggaugaggcucauuucacagacccagccaguauagcggcuagaggguacauaucaacucgugugggaaugggagaggcagccgcaauuuucaugacagccacacccccuggaacagcugaugccuuuccucagagcaacgcuccaauucaagaugaagaaagagacaucccagaacgcucauggaauucaggcaaugauuggauuaccgacuuugccgggaagacugugugguuuguccccagcaucaaagcuggaaaugacauagcaaacugcuugcgaaaaaauggaaaaaaggucauucaacuuaguaggaaaacuuuugacacagaauaucaaaagacuaaacuaaaugauugggacuuuguggugacaacagacauuucggaaaugggagccaauuucaaagcagacagagugaucgacccaagaagaugucucaagccagucauuuugacagacggacccgagcgugugauccuggcaggaccaaugccagucaccguagcgagugcugcacaaaggagagggagaguuggcaggaacccacaaaaagaaaaugaccaauacauauucacgggccagccccucaacaaugaugaagaccacgcucacuggacagaagcaaaaaugcugcuagacaacauuaacacaccagaagggaucauaccagcucucuuugaaccagaaagggagaagucagccgccauagacggcgaauaccgccugaaaggugagucccggaagacuuucguggaacucaugaggaggggugaccucccaguuuggcuagcccauaaaguagcaucagaaggaaucaaauacacagauagaaaaugguguuuugauggagagcgcaacaaucaaauuuuagaggagaauauggauguggaaauuuggacaaaggaaggagaaaagaaaaaauugaggccuagguggcuugacgcccgcacuuauucagaucccuuagcgcucaaggaauucaaggacuuugcggcugguagaaagucgaucgccuuugaucuuguaacagaaauaggaagagugccuucacauuuagcccacagaacgagaaaugcucuggacaauuugguaauguugcacacgucagaacacggugggagggccuacaggcaugcaguggaggaauuaccagaaacaauggaaacacucuuacuccugggacucaugauccuguuaacagguggggcaaugcuuuucuugauaucaggcaaagggauuggaaagacuucaauaggacuuauuuguguaguugcuuccagcggcauguuauggauggcugauaucccacuccaauggaucgcgucggccauaguucuggaguuuuuuaugauggugcuacuuauaccagaaccagaaaagcagagaacuccccaagauaaucaacucgcauaugucgugauaggcauacuuacauuggcugcaauaguagcggccaaugaaaugggauuguuggaaaccacaaagagagauuuggggauguccaaagaaccagguguugucucuccaaccagcuauuuggauguggauuugcacccagcaucagcuuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggauuuaggcguaccacuauuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaacccaacgguggaugggauaaugacaauagaccuagauccuguaauauacgauucaaaauuugaaaaacaacuaggacaaguuaugcuccugguucugugugcaguucaacucuuguuaaugagaacaucaugggcauuuugugaagcucuaacccuagccacaggaccaauaacaacacucugggaaggaucaccagggaaguucuggaacaccacgauagcuguuuccauggcgaacaucuuuagagggagcuauuuagcaggagcugggcucgcuuuuucuaucaugaaaucaguuggaacaggaaagagaggaacagggucacaaggugaaacuuugggagaaaaguggaaaaagaaauugaaucaauugucccggaaagaguucgaccuuuacaagaaauccggaaucacugaaguggauagaacagaagcuaaagaaggguugaaaagaggagaaauaacacaccaugccguauccagaggcagcgcaaaacuucaaugguucguggagagaaacauggucaucccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcuaaugaguggaaaggauguguuuuaucuuccaccugaaaagugugacacucuauugugugacauuggagagucuucaccaagcccaacaguggaagagagcagaaccauaagagucuugaaaaugguugaaccauggcuaaaaaacaaccaguuuugcaucaaaguauugaacccuuauaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacuacuacugaacagauucacaaugacauauaggagacccaccauagagaaagauguggauuuaggagcggggacccgacaugucaaugcggaaccagaaacaccuaacauggaugucauuggggaaagaauaaggaggauuaaggaggagcauaguucaacauggcacuaugaugaugaaaauccuuacaaaacgugggcuuaccauggaucuuaugaaguuaaggccacagguucagccuccuccaugauaaauggagucguaaaacuccucacgaaaccaugggauguggugcccacggugacacagauggcaaugacggacacaacccccuuuggccagcaaaggguuuuuaaagagaaaguggacaccaggacacccaaacccaugccaggaacaagaaaggucauggagaucacagcagaauggcuuuggagaacccugggaaggaauaaaagacccagauuaugcacgagagaggaguucacaaaaaaggucagaaccaacgcagcuaugggcgccguauucacagaggagaaccaaugggacagugccagagcugccguugaagaugaagaauucuggaaacucguggacagagaacgugagcuccacaaacugggcaaguguggaagcugcguuuauaacaugaugggcaagagagagaagaaacuuggagaguuuggcaaagcaaaaggcaguagagccauaugguacauguggcugggagccagguaccuugaguucgaggcacucggauucuuaaaugaagaccauugguucucgcgugaaaacucuuacaguggaguagaaggggaaggacugcauaagcugggauacaucuugagagacauuuccaagauaccaggaggagccauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugauuagacaaauggaaggagaagguguguugucgaagacagaccucgagaacccucaucugcuagagaagagaauuacacaaugguuggaaaccaaaggaguggagagguuaaaaagaauggccaucagcggggacgauugcguggugaaaccaaucgaugacagguucgccaaugcccugcuugcccugaaugauaugggaaaaguuaggaaggacauaccucaauggcaaccaucgaagggauggcaugauuggcaacaggucccuuucugcucccaccacuuucaugaauugauuaugaaagauggaagaaaguugguaguccccugcagaccucaggaugaauuaauagggagagcgagaaucucucaaggagcaggauggagccuuaaagaaacugcaugccuagggaaagccuacgcccaaaugugggcucucauguauuuucacagaagagaucuuagacuagccuccaacgccauauguucagcaguaccaguccauuggguccccacaagcagaacgacuugguccauccaugcucaccaucaguggaugacuacagaagauaugcuuacuguuuggaacaggguguggauagaggacaauccauggauggaagacaaaacuccaguuacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggaguuagagggagccauuugguaa

SEQ ID NO: 7185 - RNA, 9873 nt, Artificial Sequence
  derived and/or modified CDS sequence (wt) from DENV-3__AB214882__SS-prME
acaucgcucugucucaugaugauguuaccagcaacacuugcuuuccacuugacuucacgagauggagagccgcgcaugauuguggggaagaaugaaagaggaaaaucccugcuuuucaagacagccucuggaaucaacaugugcacacucauagccauggauuugggagaaaugugugaugacacggucacuuacaaaugcccccucauuacugaaguggagccugaggacauugacugcuggugcaaccucacaucgacgugggugaccuacggaacgugcaaccaagcuggagagcauagacgcgauaaaagaucgguggcguuagcuccccauguuggcaugggacuggacacacgcacccaaaccuggaugucggcugaaggagcuuggagacaagucgagaagguagagacaugggccuuuaggcacccaggguucacaauacuagcccuauuucuugcccauuacauagggacuuccuugacccagaaaguggucauuuucauacugcuaauguuggucacuccauccaugacaaugagaugugugggaguaggaaacagagauuuuguggaaggccuaucaggagcuacguggguugacguggugcucgaacacggugggugugugacuaccauggcuaagaacaagcccacgcuggauauagagcuccagaagaccgaggccacccaacuagcaacccuaaggaaacuaugcauugagggaaaaaucaccaacgugacaaccgacucaaggugccccacccaaggggaagcgauuuuaccugaggagcaggaccagaacuacguguguaagcacacauacguggacagaggcuggggaaacgguuguggcuuguuuggcaagggaagcuugguaacaugcgcgaaauuucaauguuuggaaucaauagagggaaaaguggugcagcaugagaaccucaaauacaccgucaucaucacggugcacacaggagaccaacaccaggugggaaaugaaacgcagggagucacggcugagauaacaccccaggcaucaaccgucgaagccgucuuaccugaauauggaacccuugggcuagaaugcucaccacggacagguuuggacuuuaaugaaaugauuuuguugacaaugaagaacaaagcauggaugguacacagacaaugguuuuuugaccuaccucuaccauggacaucaggggcuacaacagaaacaccaaccuggaauaagaaagagcuucuugugacauucaaaaacgcacacgcaaaaaaacaagaaguagugguccuuggaucgcaagagggagcaaugcacacagcacugacaggagcuacagagauccaaaccucaggaggcacaaguauuuuugcggggcacuuaaaaugcagacucaagauggacaaauuggaacucaaggggaugagcuaugcaaugugcucaaaugccuuuguguugaagaaagaagucucugaaacacagcauggaacaauacucauaaaggucgaguacaaaggggaagaugcacccugcaagauuccuuucuccacggaggauggacaagggaaagcccacaauggcagacugaucacagccaacccaguggugaccaagaaggaagagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucauuggggaaaauggugcaccaaauauuuggaagcgcuuacacggcccuuuuuaguggagucuccuggauaaugaaaauuggaauagguguccuuuuaacuuggauaggguugaauucaaaaaacacuucuaugucauuuucaugcauugugauuggaaucaucacacucuaucugggagcuguggugcaagcugacauggggugugucauaaacuggaaaggcaaagaacuuaaauguggaaguggaauuuucguuacuaaugagguccacaccuggacagagcaauacaaauuucaagcagacuccccaaaaagacuggcgacagccauugcaggcgccugggagaauggaguguguggaaucaggucgacaaccagaauggagaaccucuuguggaagcaaauagccaaugaacuaaacuacauauuaugggaaaacaacaucaaauuaacgguaguugugggugauauaacugggaucuuagagcaagggaaaagaacacuaacaccacaacccauggagcuaaaauauucauggaaaacauggggaaaggcgaaaauagugacagcugaaacacaaaauucuuccuucauaauagaugggcccaacacaccagaguguccaagugccucgagagcauggaaugugugggagguggaagauuacggguucggaguuuucacaaccaauauauggcugaaacuccgagagauguacacccaacugugugaccacaggcuaaugucggcagccguuaaggaugagagagccguacacgccgacaugggcuauuggauagaaagccaaaagaauggaaguuggaagcuagaaaaggcaucucucauagaggugaaaaccugcacauggccaaagucacacacucucuggagcaaugguguguuggagagugauaugaucaucccaaagagucuggcugguccuaucucgcaacacaacuacaggcccggauaccacacccaaacggcaggacccuggcaccuaggaaaauuggagcuggacuuuaacuauugugagggaacaacaguugucaucacagaaaauugugggacaagaggcccaucacugaggacaacaacagugucagggaaauugauacacgaaugguguugccgcucgugcacacuuccuccucugcgauacaugggagaagacggcugcugguauggcauggaaauuagacccauuaaugagaaagaagagaauaugguaaagucuuuagucucagcagggaguggaaagguggacaacuucacaaugggugucuuauguuuggcaauccucuuugaagagguaaugagaggaaaauucggaaaaaagcacaugauugcagggguucucuucacauuugugcuccuucucucugggcaaauaacauggagagacauggcgcguacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguuggguuggccauggcaacaacguugcaacugccagaggacauugaacaaauggcgaauggaauagccuuggggcucauggcucuuaaauugauaacacaauucgaaacauaccaacuguggacggcauuagccucccuaauguguucaaacacaauuuucacguugacuguugccuggagaacagccacccugauuuuggccggaauuucgcuuuugccagugugccagucuucgagcaugaggaaaacagauuggcuaccaaugacuguggcagcuaugggaguuccaccucuaccacuuuuuaucuucaguuugaaagacacacucaaaaggagaagcuggccacugaaugagggggugauggccguuggacuugugagcauuuuggcaagcucucuccuuaggaaugacguacccauggcuggaccauuaguggcugggggcuugcugauagcgugcuacgucauaacuggcacgucagcagaccuuacuguagaaaaagcagcagaugugacaugggaggaagaggcugagcaaacaggagugucccacaaucuaaugaucacaguugaugaugauggaacaaugagaauaaaagaugaugagacugagaacaucuuaacagugcuuuugaaaacagcauuacuaauagugucaggcauuuuuccauacuccauacccgcaacacuguuggucuggcauacuuggcaaaagcaaacccaaagauccggcguccuaugggacguaccuagccccccagagacacagaaagcagaacuggaagaaggggucuauaggaucaagcagcaaggaauuuuugggaagacccaaguggggguuggaguacaaaaagaaggaguuuuccacaccauguggcacgucacaagaggagcaguguugacacacaaugggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacgacaggggagauaggagcgauugcacuggacuucaagccuggaacuucaggaucucccaucauaaacagagagggaaagguagugggacuguacggcaauggaguggucacaaagagugguggcuaugucaguggaauagcucaaacaaacgcagaaccagacggaccgacaccagaguuggaagaagagauguucaaaaagcgaaauuuaaccauaauggaucuccaucccgggucaggaaagacgcggaaauaccuuccagccauaguuagagaggcaaucaagagacgcuuaaggacccuaauuuuggcaccaacaagggugguugcagcugagauggaagaagcauugaaagggcucccaauaagguaucaaacaacugcaacaaaauccgaacacacagggaaagagauuguugaucuaaugugucaugcaacguucacaaugcguuugcugucaccagucagaguuccaaacuacaacuugauaauaauggaugaggcucauuucacagacccagccaguauagcggcuagaggguacauaucaacucgugugggaaugggagaggcagccgcaauuuucaugacagccacacccccuggaacagcugaugccuuuccucagagcaacgcuccaauucaagaugaagaaagagacaucccagaacgcucauggaauucaggcaaugauuggauuaccgacuuugccgggaagacugugugguuuguccccagcaucaaagcuggaaaugacauagcaaacugcuugcgaaaaaauggaaaaaaggucauucaacuuaguaggaaaacuuuugacacagaauaucaaaagacuaaacuaaaugauugggacuuuguggugacaacagacauuucggaaaugggagccaauuucaaagcagacagagugaucgacccaagaagaugucucaagccagucauuuugacagacggacccgagcgugugauccuggcaggaccaaugccagucaccguggcgagugcugcacaaaggagagggagaguuggcaggaacccacaaaaagaaaaugaccaauacauauucacgggccagccccucaacaaugaugaagaccacgcucacuggacagaagcaaaaaugcugcuagacaacauuaacacaccagaagggaucauaccagcucucuuugaaccagaaagggagaagucagccgccauagacggcgaauaccgccugaaaggugagucccggaagacuuucguggaacucaugaggaggggugaccucccaguuuggcuagcccauaaaguagcaucagaaggaaucaaauacacagauagaaaaugguguuuugauggagagcgcaacaaucaaauuuuagaggagaauauggauguggaaauuuggacaaaggaaggagaaaagaaaaaauugaggccuagguggcuugacgcccgcacuuauucagaucccuuagcgcucaaggaauucaaggacuuugcggcugguagaaagucgaucgccuuugaucuuguaacagaaauaggaagagugccuucacauuuagcccacagaacgagaaaugcucuggacaauuugguaauguugcacacgucagaacacggugggagggccuacaggcaugcaguggaggaauuaccagaaacaauggaaacacucuuacuccugggacucaugauccuguuaacagguggggcaaugcuuuucuugauaucaggcaaagggauuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagauaaucaacucgcauaugucgugauaggcauacuuacauuggcugcaauaguagcagccaaugaaaugggauuguuggaaaccacaaagagagauuuggggauguccaaagaaccagguguuguuucuccaaccagcuauuuggauguggauuugcacccagcaucagcuuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggauuuaggcguaccacuacuggcacuggguugcuauucacaagugaacccacuaacucucacagcggcaguacuccugcuagucacgcauuaugccauuauagguccaggauugcaggcaaaagccacucgugaagcucaaaaaaggacggcugcuggaauaaugaagaacccaacgguggaugggauaaugacaauagaccuagauccuguaauauacgauucaaaauuugaaaaacaacuaggacaaguuaugcuccugguucugugugcaguucaacucuuguuaaugagaacaucaugggcauuuugugaagcucuaacccuagccacaggaccaauaacaacacucugggaaggaucaccagggaaguucuggaacacuacgauagcuguuuccauggcgaacaucuuuagagggagcuauuuagcaggagcugggcucgcuuuuucuaucaugaaaucaguuggaacaggaaagagaggaacagggucacaaggugaaacuuugggagaaaaguggaaaaagaaauugaaucaauugucccggaaagaguuugaccuuuacaagaaauccggaaucacugaaguggauagaacagaagcuaaagaaggguugaaaagaggagaaauaacacaccaugccguauccagaggcagcgcaaaacuucaaugguucguggagagaaacauggucaucccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcuaaugaguggaaaggauguguuuuaucuuccaccugaaaagugugacacucuauugugugacauuggagagucuucaccaagcccaacaguggaagagagcagaaccauaagagucuugaaaaugguugaaccauggcuaaaaaacaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacuacuacugaacagauucacaaugacauauaggagacccaccauagagaaagauguggauuuaggagcggggacccgacaugucaaugcggaaccagaaacaccuaacauggaugucauuggggaaagaauaaggaggauuaaggaggagcauaguucaacauggcacuaugaugaugaaaauccuuacaaaacgugggcuuaccauggaucuuaugaaguuaaggccacagguucagccuccuccaugauaaauggagucguaaaacuccucacgaaaccaugggauguggugcccacggugacacagauggcaaugacggacacaacccccuuuggccagcaaaggguuuuuaaagagaaaguggacaccaggacacccaaacccaugccaggaacaagaaaggucauggagaucacagcagaauggcucuggagaacccugggaaggaauaaaagacccagauuaugcacgagagaggaguucacaaaaaaggucagaaccaacgcagcuaugggcgccguauucacagaggagaaccaaugggacagugccagagcugccguugaagaugaagaauucuggaaacucguggacagagaacgugagcuccacaaacugggcaaguguggaagcugcguuuauaacaugaugggcaagagagagaagaaacuuggagaguuuggcaaagcaaaaggcaguagagccauaugguacauguggcugggagccagguaccuugaguucgaggcacucggauucuuaaaugaagaccauugguucucgcgugaaaacucuuacaguggaguagaaggggaaggacugcauaagcugggauacaucuugagagacauuuccaagauaccaggaggagccauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugauuagacaaauggaaggagaagguguguugucgaagacagaccucgagaacccucaucugcuagagaagagaauuacacaaugguuggaaaccaaaggaguggagagguuaaaaagaauggccaucagcggggacgauugcguggugaaaccaaucgaugacagguucgccaaugcccugcuugcccugaaugacaugggaaaaguuaggaaggacauaccucaauggcaaccaucgaagggauggcaugauuggcaacaggucccuuucugcucccaccacuuucaugaauugauuaugaaagauggaagaaaguugguaguccccugcagaccucaggaugaauuaauagggagagcgagaaucucucaaggagcaggauggagccuuaaagaaacugcaugccuagggaaagccuacgcccaaaugugggcucucauguauuuucacagaagagaucuuagacuagccuccaacgccauauguucagcaguaccaguccauuggguccccacaagcagaacgacuugguccauccaugcucaccaucaguggaugacuacagaagauaugcuuacuguuuggaacaggguguggauagaggacaauccauggauggaagacaaaacuccaguuacaacuugggaagauguuccauaucuagggaagagagaagaccaauggugcggaucacucauuggucucacuuccagagcaaccugggcccagaacauacuuaccgcaauccaacagguaaggagccuuauaggcaaugaagaguuucuggacuacaugccuucgaugaagagauucaggaaggaggaggagucagagggagccauuugguaa

SEQ ID NO: 7186 - RNA, 9873 nt, Artificial Sequence
  derived and/or modified CDS sequence (wt) from DENV-3__JX669489__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucaucacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcgggggugcucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauagcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaaugcuaagacauaccauagagaauucuacagcaaaugugucucuggcggcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgccaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7187 - RNA, 9873 nt, Artificial Sequence
  derived and/or modified CDS sequence (wt) from DENV-3__JX669498__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuuaguaacaugugcgaaauuucaaugccuggaaucaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccauuuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagcgauaugaucaucccaaagaguuuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaagugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuacaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccaguggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaaaagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaagaacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugaaaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacuggguaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaagggguggagagguuaaaaagaauggccauuagcggggaugauugcguagugaaaccaaucgaugacagguucgguaaugcccugcucgcucugaacgauaugggaaagguucggaaggacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7188 - RNA, 9873 nt, Artificial Sequence
  derived and/or modified CDS sequence (wt) from DENV-3__KF954946__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagaaaugugugaugacacggucacuuacaaaugcccccacauuaccgaaguggaaccugaagacauugacugcuggugcaaccuuacaucaacaugggugacuuauggaacguguaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcauccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgauccuaaggaagcuaugcauugaggggaaaauuaccaacauaacaacugacucaagaugucccacccaaggagaagcgguuuugccugaggagcaggaccagaacuacguguguaagcacacauacguagauagaggcugggggaacggcugugguuuguucggcaagggaagcuugguaacaugugcgaaauuucaaugccuggaaccgauagagggaaaaguagugcaauaugagaaccucaaauacaccgucaucauuacagugcacacaggagaccaacaccaggugggaaaugaaacgcagggaaucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagccacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaacauugaggcugaaccuccuuuuggggaaaguaauauaguaauuggaauuggagacaaugccuugaaaaucaauugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuuaacuuggauaggguugaauucaaaaaacacauccaugucauuuucaugcauugcaauaggaaucaucacacucuauuugggagcugugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauuguaggugcuugggaaaauggaguguguggaauuaggucaacaaccagaauggagaaucucuuguggaagcaaauagccaaugaacugaacuacauauuaugggaaaacaacaucaaauuaacgguaguugugggcgacacaaucgggguuuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuacuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaauugugggacaagaggcccaucauugagaacgacaacagugucaggaaaguugauacaugaaugguguugccgcucgugcacacuuccuccccugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggagucggacuggcuauggcaacaacguuacaauugccagaggacauugaacaaauggcaaauggaaucgcccuggggcucauggcucuuaaauugauaacacaauuugaaacauaccaauuauggacagcauuaaucuccuuaacguguucaaauacaauuuucacguugacuguugcuuggagaacagccacccugauuuuggccggaguuucacuuuuaccagugugccagucuucgagcaugagaaaaacagacuggcuuccaaugacaguggcagcuaugggagucccaccccuaccacucuuuauuuuuagcuugaaagacacacucaaaaggagaagcuggccacugaaugagggggugauggcuguuggacuugugagcaugcuggccaguucucuccuuagaaaugacgugcccauggcuggaccauuaguggccgggggcuugcugauagcgugcuacgucauaacuggcacgucagcagaccuuacaguggaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauaccagcgacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagacggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaauccaaagaacuuccaaaccaugccaggcacauuccagacuacaacaggggaaauaggagcaauugcauuggauuucaagccuggaacuucggggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaucuuccagccauuguuagagaggcaaucaagagacguuuaagaacucugauucuggcaccgacaagggugguugcagcugagauggaagaagcauugaaggggcucccaauaagguaccaaacaacagcaacaaaaucugaacauacgggaagagagauuguugaucuaaugugccacgcaacguucacaaugcgcuugcugucaccaguuaggguuccaaauuacaacuugauaauaauggaugaggcccauuucacagacccagccaguauagcggccagaggguacauaucaacucguguuggaaugggagaggcagccgcaaucuucaugacggcaacgcccccuggaacagcugaugccuuuccucagagcaacgcuccaauucaagaugaagaaagggacauaccagaacgcucauggaauucaggcaaugaauggaucaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugacugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugacgaagaccaugcucacuggacagaagcaaaaaugcugcuggacaacaucaacacuccagaaggaaucauaccagcucucuuugaaccagaaagggagaagucagccgccauagacggugaauaucgccugaagggugaauccaggaagacuuucguggaacucaugaggaggggugaccucccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcaggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucguaauaggcauacuuacaauggcugcaauaauagcggccaaugaaaugggacuacuggaaacuacaaagagagaucuaggaaugucuaaggaaccagguguuguuucuccaacuagcuauuuggauguggauuugcacccagcaucagccuggacauuguacgcuguggccacuacaguaauaacaccaauguuaagacauaccauagagaauucuacagcaaaugugucccuggcagcuauagccaaccaggcagugguccuguuggguuuggacaaaggauggccaauaucaaaaauggacuuaggcguaccacuacuggcauuggguugcuauucacaagugaacccacugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagacccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuucuauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagggguagugcaaaacuucaaugguuuguggaaaggaacauggucauucccgagggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaauuaaugaguggaaaggauguguuuuaucuuccgccugaaaagugugacacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccagccgugauugagcaccuagaaagacugcaaaggaaacacggaggaaugcuugugagaaauccacuuucacgaaacuccacgcacgaaauguacuggauaucuaaugguacagguaacauugucucuucaguuaacaugguauccagauuguuacugaacagguucacgaugacacacaggagaccuaccauagagaaagauguggauuuaggagcaggaacucgacaugucaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaacggagucgugaaacuucucacuaaaccaugggauguagugcccauggugacacagauggcaaugacagauacaacuccauuuggccagcagagagucuuuaaagagaagguggacaccaggacacccaggccuaugccagggacaagaaagguuauggagaucacagcggaguggcucuggagaacccugggaaggaacaaaagacccagguuaugcacaagggaagaguucacaaaaaaggucagaaccaacgcagccaugggcgccguuuucacagaggagaaccaaugggacagugcgaaagccgcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacaacaaauggacccugaacacaggcuguuagcgaacgcuauauuuaagcucacauaccaaaacaaaguggucaaaguucaacgaccgacuccaacgggcacgguaauggacauuauaucuaggaaagaccaaagaggcaguggacaggugggaacuuauggucugaacacauuuacuaacauggaagcccaguuagucagacaaauggaaggagaaggugugcugucaaagacagaccucgagaacccucaucugccagaaaagaaaauuacacaauggcuggaaaccaaaggaguggagagguuaaaaagaauggccauuagcggggaugauugcguagugaaaccaaucgaugacagguucgcuaacgcacugcuugcccugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaauaccaguccacuggguccccacaaguagaacgacauggucuauucaugcucaccaucaguggaugaccacagaagacaugcuuacuguuuggaacaggguguggaucgaggacaauccauggauggaagacaaaacuccaauuacaaccugggaaaauguuccauaccuagggaagagggaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7189 - RNA, 9873 nt, Artificial Sequence
  derived and/or modified CDS sequence (wt) from DENV-3__KF954947__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagaaaugugugaugacacggucacuuacaaaugcccccacauuaccgaaguggaaccugaagacauugacugcuggugcaaccuuacaucaacaugggugacuuauggaacguguaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcauccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagaugucccacccaaggggaagcgguuuugccugaggagcaggaccagaacuacguguguaagcacacauacguagauagaggcugggggaacggcugugguuuguucggcaagggaagcuugguaacaugugcgaaauuucaaugccuggaaccgauagagggaaaaguagugcaauaugagaaccucaaauacaccgucaucauuacagugcacacaggagaccaacaccaggugggaaaugaaacgcagggaaucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagccacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaacauugaggcugaaccuccuuuuggggaaaguaauauaguaauuggaauuggagacaaugccuugaaaaucaauugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuuaacuuggauaggguugaauucaaaaaacacauccaugucauuuucaugcauugcaauaggaaucaucacacucuauuugggagcugugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauuguaggugcuugggaaaauggaguguguggaauuaggucaacaaccagaauggagaaucucuuguggaagcaaauagccaaugaacugaacuacauauuaugggaaaacaacaucaaauuaacgguaguugugggcgacacaaucgggguuuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuacuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaauugugggacaagaggcccaucauugagaacgacaacagugucaggaaaguugauacaugaaugguguugccgcucgugcacacuuccuccccugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggagucggacuggcuauggcaacaacguuacaauugccagaggacauugaacaaauggcaaauggaaucgcccuggggcucauggcucuuaaauugauaacacaauuugaaacauaccaauuauggacagcauuaaucuccuuaacguguucaaauacaauuuucacguugacuguugcuuggagaacagccacccugauuuuggccggaguuucacuuuuaccagugugccagucuucgagcaugagaaaaacagacuggcuuccaaugacaguggcagcuaugggagucccaccccuaccacucuuuauuuuuagcuugaaagacacacucaaaaggagaagcuggccacugaaugagggggugauggcuguuggacuugugagcaugcuggccaguucucuccuuagaaaugacgugcccauggcuggaccauuaguggccgggggcuugcugauagcgugcuacgucauaacuggcacgucagcagaccuuacaguggaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauaccagcgacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagacggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaauccaaagaacuuccaaaccaugccaggcacauuccagacuacaacaggggaaauaggagcaauugcauuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaucuuccagccauuguuagagaggcaaucaagagacguuuaagaacucugauucuggcaccgacaagggugguugcagcugagauggaagaagcauugaaggggcucccaauaagguaccaaacaacagcaacaaaaucugaacauacgggaagagagauuguugaucuaaugugccacgcaacguucacaaugcgcuugcugucaccaguuaggguuccaaauuacaacuugauaauaauggaugaggcccauuucacagacccagccaguauagcggccagaggguacauaucaacucguguuggaaugggagaggcagccgcaaucuucaugacggcaacgcccccuggaacagcugaugccuuuccucagagcaacgcuccaauucaagaugaagaaagggacauaccagaacgcucauggaauucaggcaaugaauggaucaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugacugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugacgaagaccaugcucacuggacagaagcaaaaaugcugcuggacaacaucaacacuccagaaggaaucauaccagcucucuuugaaccagaaagggagaagucagccgccauagacggugaauaucgccugaagggugaauccaggaagacuuucguggaacucaugaggaggggugaccucccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcaggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucguaauaggcauacuuacaauggcugcaauaauagcggccaaugaaaugggacuauuggaaacuacaaagagagaucuaggaaugucuaaggaaccagguguuguuucuccaacuagcuauuuggauguggauuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagacccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuucuauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagggguagugcaaaacuucaaugguuuguggaaaggaacauggucauucccgagggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaauuaaugaguggaaaggauguguuuuaucuuccgccugaaaagugugacacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccagccgugauugagcaccuagaaagacugcaaaggaaacacggaggaaugcuugugagaaauccacuuucacgaaacuccacgcacgaaauguacuggauaucuaaugguacagguaacauugucucuucaguuaacaugguauccagauuguuacugaacagguucacgaugacacacaggagaccuaccauagagaaagauguggauuuaggagcaggaacucgacaugucaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaacggagucgugaaacuucucacuaaaccaugggauguagugcccauggugacacagauggcaaugacagauacaacuccauuuggccagcagagagucuuuaaagagaagguggacaccaggacacccaggccuaugccagggacaagaaagguuauggagaucacagcggaguggcucuggagaacccugggaaggaacaaaagacccagguuaugcacaagggaagaguucacaaaaaaggucagaaccaacgcagccaugggcgccguuuucacagaggagaaccaaugggacagugcgaaagccgcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacaacgaauggacccugaacacaggcuguuagcgaacgcuauauuuaagcucacauaccaaaacaaaguggucaaaguucaacgaccgacuccaacgggcacgguaauggacauuauaucuaggaaagaccaaagaggcaguggacaggugggaacuuauggucugaacacauuuacuaacauggaagcccaguuagucagacaaauggaaggagaaggugugcugucaaagacagaccucgagaacccucaucugccagaaaagaaaauuacacaauggcuggaaaccaaaggaguggagagguuaaaaagaauggccauuagcggggaugauugcguagugaaaccaaucgaugacagguucgcuaacgcacugcuugcccugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaauaccaguccacuggguccccacaaguagaacgacauggucuauucaugcucaccaucaguggaugaccacagaagacaugcuuacuguuuggaacaggguguggaucgaggacaauccauggauggaagacaaaacuccaauuacaaccugggaaaauguuccauaccuagggaagagggaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7190 - RNA, 9873 nt, Artificial Sequence
  derived and/or modified CDS sequence (wt) from DENV-3__KF954945__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagaaaugugugaugacacggucacuuacaaaugcccccacauuaccgaaguggaaccugaagacauugacugcuggugcaaccuuacaucaacaugggugacuuauggaacguguaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcauccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgauccuaaggaagcuaugcauugaggggaaaauuaccaacauaacaacugacucaagaugucccacccaaggggaagcgguuuugccugaggagcaggaccagaacuacguguguaagcacacauacguagauagaggcugggggaacggcugugguuuguucggcaagggaagcuugguaacaugugcgaaauuucaaugccuggaaccgauagagggaaaaguagugcaauaugagaaccucaaauacaccgucaucauuacagugcacacaggagaccaacaccaggugggaaaugaaacgcagggaaucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagccacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaacauugaggcugaaccuccuuuuggggaaaguaauauaguaauuggaauuggagacaaugccuugaaaaucaauugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuuaacuuggauaggguugaauucaaaaaacacauccaugucauuuucaugcauugcaauaggaaucaucacacucuauuugggagcugugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauuguaggugcuugggaaaauggaguguguggaauuaggucaacaaccagaauggagaaucucuuguggaagcaaauagccaaugaacugaacuacauauuaugggaaaacaacaucaaauuaacgguaguugugggcgacacaaucgggguuuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuacuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaauugugggacaagaggcccaucauugagaacgacaacagugucaggaaaguugauacaugaaugguguugccgcucgugcacacuuccuccccugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuucuaagaaaacugacaucuagagaaaauuuacuguuaggagucggacuggcuauggcaacaacguuacaauugccagaggacauugaacaaauggcaaauggaaucgcccuggggcucauggcucuuaaauugauaacacaauuugaaacauaccaauuauggacagcauuaaucuccuuaacguguucaaauacaauuuucacguugacuguugcuuggagaacagccacccugauuuuggccggaguuucacuuuuaccagugugccagucuucgagcaugagaaaaacagacuggcuuccaaugacaguggcagcuaugggagucccaccccuaccacucuuuauuuuuagcuugaaagacacacucaaaaggagaagcuggccacugaaugagggggugauggcuguuggacuugugagcaugcuggccaguucucuccuuagaaaugacgugcccauggcuggaccauuaguggccgggggcuugcugauagcgugcuacgucauaacuggcacgucagcagaccuuacaguggaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauaccagcgacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagacggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaauccaaagaacuuccaaaccaugccaggcacauuccagacuacaacaggggaaauaggagcaauugcauuggauuucaagccuggaacuucggggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaucuuccagccauuguuagagaggcaaucaagagacguuuaagaacucugauucuggcaccgacaagggugguugcagcugagauggaagaagcauugaaggggcucccaauaagguaccaaacaacagcaacaaaaucugaacacacaggaagagagauuguugaucuaaugugccacgcaacguucacaaugcgcuugcugucaccaguuaggguuccaaauuacaacuugauaauaauggaugaggcccauuucacagacccagccaguauagcggccagaggguacauaucaacucguguuggaaugggagaggcagccgcaaucuucaugacggcaacgcccccuggaacagcugaugccuuuccucagagcaacgcuccaauucaagaugaagaaagggacauaccagaacgcucauggaauucaggcaaugaauggaucaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugacugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugacgaagaccaugcucacuggacagaagcaaaaaugcugcuggacaacaucaacacuccagaaggaaucauaccagcucucuuugaaccagaaagggagaagucagccgccauagacggugaauaucgccugaagggugaauccaggaagacuuucguggaacucaugaggaggggugaccucccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcaggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucguaauaggcauacuuacaauggcugcaauaauagcggccaaugaaaugggacuacuggaaacuacaaagagagaucuaggaaugucuaaggaaccagguguuguuucuccaacuagcuauuuggauguggauuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagacccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuucuauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagggguagugcaaaacuucaaugguuuguggaaaggaacauggucauucccgagggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaauuaaugaguggaaaggauguguuuuaucuuccgccugaaaagugugacacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccagccgugauugagcaccuagaaagacugcaaaggaaacacggaggaaugcuugugagaaauccacuuucacgaaacuccacgcacgaaauguacuggauaucuaaugguacagguaacauugucucuucaguuaacaugguauccagauuguuacugaacagguucacgaugacacacaggagaccuaccauagagaaagauguggauuuaggagcaggaacucgacaugucaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaacggagucgugaaacuucucacuaaaccaugggauguagugcccauggugacacagauggcaaugacagauacaacuccauuuggccagcagagagucuuuaaagagaagguggacaccaggacacccaggccuaugccagggacaagaaagguuauggagaucacagcggaguggcucuggagaacccugggaaggaacaaaagacccagguuaugcacaagggaagaguucacaaaaaaggucagaaccaacgcagccaugggcgccguuuucacagaggagaaccaaugggacagugcgaaagccgcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacaacaaauggacccugaacacaggcuguuagcgaacgcuauauuuaagcucacauaccaaaacaaaguggucaaaguucaacgaccgacuccaacgggcacgguaauggacauuauaucuaggaaagaccaaagaggcaguggacaggugggaacuuauggucugaacacauuuacuaacauggaagcccaguuagucagacaaauggaaggagaaggugugcugucaaagacagaccucgagaacccucaucugccagaaaagaaaauuacacaauggcuggaaaccaaaggaguggagagguuaaaaagaauggccauuagcggggaugauugcguagugaaaccaaucgaugacagguucgcuaacgcacugcuugcccugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaauaccaguccacuggguccccacaaguagaacgacauggucuauucaugcucaccaucaguggaugaccacagaagacaugcuuacuguuuggaacaggguguggaucgaggacaauccauggauggaagacaaaacuccaauuacaaccugggaaaauguuccauaccuagggaagagggaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7191 - RNA, 9873 nt, Artificial Sequence
  derived and/or modified CDS sequence (wt) from DENV-3__JX669495__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauuggaaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucaucacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacggugguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaggucauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucagcuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauuuaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagagaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggaucuaggagcaggaacucgacauguuaaugcggaaccagaaacacccaacauggaugucauuggggaaagaauaaaaaggaucaaggaggagcauaauucaacauggcacuaugaugacgaaaaccccuacaaaacuugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaguuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7192 - RNA, 9873 nt, Artificial Sequence
  derived and/or modified CDS sequence (wt) from DENV-3__JX669499__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggccgaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguuuugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaauuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguuuggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccuuugcgauacaugggagaagacgguugcugguauggcauggaaaucagacccaucagugaaaaagaagagaacaugguaaagucuuuagucucagcgggaaguggaaagguggacaacuucacaaugggugucuuauguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcauuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcacuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuugucccuagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcgguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguuugaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7193 - RNA, 9873 nt, Artificial Sequence
  derived and/or modified CDS sequence (wt) from DENV-3__JX669492__SS-prME
acaucguucugucucaugaugauauugccagcagcacuugcuuuccacuugacuucacgagauggagagccgcgcaugauaguggggaagaaugaaagaggaaaaucccuacuuuuuaagacagccucuggaaucaacaugugcacacucauagccauggaccugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaacccccuuuuggggaaaguaauauagugauuggaauuggagacaacgccuugaaaaucaacugguauaagaaaggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaccuccuguggaagcaaauagccaaugaacugaacuacauauugugggaaaacaauaucaaauuaacggugguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuacuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuagggguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacacugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcagauagaguaaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccacaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauagagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaagucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauaggcaaugaagaguuucuggacuacaugccuucaaugaagagauucaggaaggaggaggagucggagggagccauuugguaa

SEQ ID NO: 7194 - RNA, 9873 nt, Artificial Sequence
  derived and/or modified CDS sequence (wt) from DENV-3__JX669500__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggacuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucgagauguccuacccaaggggaagcgguuuugccugaggagcaggaccagaacuacguguguaagcauacauacguagacagaggcugggggaacggaugugguuuguuuggcaaaggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcgaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaauuaucacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccaggauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaagugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagagugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauauucaugacagcaacgcccccuggaacagcugaugccuuuccacagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugcuugcgaaaaaaugggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuucgauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggccgcaauaauagcagcuaaugaaaugggauuguuggaaacuacaaagagagauuuaggaaugucuaaggagccagguguugucucuccaaccagcuacuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuugggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggcccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguuugaagcccuuggauuuuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgccaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuagaaaggaggaggagucggagggagccauuugguaa

SEQ ID NO: 7195 - RNA, 9873 nt, Artificial Sequence
  derived and/or modified CDS sequence (wt) from DENV-3__JX669497__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggaccugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugucuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaacccccuuuuggggaaaguaauauagugauuggaauuggagacaacgccucgaaaaucaacugguauaagaaaggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaccuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuacuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacacugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccacaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcucauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaagucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugccuugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucugggaaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7196 - RNA, 9873 nt, Artificial Sequence
  derived and/or modified CDS sequence (wt) from DENV-3__JX669501__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauucccuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguccugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuguaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaauuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggagcaauggugugcuagagagugacaugaucaucccaaagagucuagcugguccuauuucgcaacacaaccacaggcccggguaccacacccagacagcgggacccuggcauuuaggaaaauuagagcuggacuucaacuauugugaaggaacaacaguugucaucacagaaaacugugggacaagaggcccaucacugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaacaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggccauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcggaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacuacaggggaaauaggagcaauugcacuggauuucaagcccggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugaucuugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgauggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauguaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuucagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcaucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagccggcugggacacaagaauaacagaagaugaccugcacaaugaggaaaagaucacacagcaaauggacccugaacacaggcaguuagcgaacgcuauauuuaaacucacauaccaaaacaaaguggucaaaguucaacgaccgacuccaacaggcacgguaauggacaucauaucuaggaaagaccaaagaggcaguggacagguaggaacuuauggucugaauacauucaccaauauggaagcccaguuaaucagacaaauggaaggagaaggugugcugucaaaggcagaccucgagaacccucaucugccagagaagaaaauuacacaauggcuggaaaccaaaggaguggagagguuaaaaagaauggccauuagcggggaugauugcguagugaaaccaaucgaugacagguucgcuaaugcccugcucgcucugaacgauaugggaaagguucgaaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuagaaaggaggaggagucggagggagccauuugguaa

SEQ ID NO: 7197 - RNA, 9873 nt, Artificial Sequence
  derived and/or modified CDS sequence (wt) from DENV-3__JX669494__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaccaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauauuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcgggggugcucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauucuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggagugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaggucauugccguagagccuggaaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugcuugcgaaaaaacgggaaaaaggucauucagcuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacucacauuggcugcaauaauagcagcuaaugaaaugggauugcuggaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagccguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacacgguaucuagacugcuacugaacagguucacgaugacacacagaagacccaccacugagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcucuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7198 - RNA, 9873 nt, Artificial Sequence
  derived and/or modified CDS sequence (wt) from DENV-3__JX669503__SS-prME
acaucguucugucucaugaugauauugccagcagcacuugcuuuccacuugacuucacgagauggagagccgcgcaugauaguggggaagaaugaaagaggaaaaucccuacuuuuuaagacagccucuggaaucaacaugugcacacucauagccauggaccugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucuguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucgaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaacccccuuuuggggaaaguaauauagugauuggaauuggagacaacgccuugaaaaucaacugguauaagaaaggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaccuccuguggaagcaaauagccaaugaacugaacuacauauugugggaaaacaauaucaaauuaacggugguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuacuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaucacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuagggguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacacugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcagauagaguaaucgacccaagaagaugucucaaaccagugauccugacagauggaccagagcgggugguccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccacaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauagagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaagucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugccuugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauaggcaaugaagaguuucuggacuacaugccuucaaugaagagauucaggaaggaggaggagucggagggagccauuugguaa

SEQ ID NO: 7199 - RNA, 9873 nt, Artificial Sequence
  derived and/or modified CDS sequence (wt) from DENV-3__JX669493__SS-prME
acaucguucugucucaugaugauauugccagcagcacuugcuuuccacuugacuucacgagauggagagccgcgcaugauaguggggaagaaugaaagaggaaaaucccuacuuuuuaagacagccucuggaaucaacaugugcacacucauagccauggaccugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaacccccuuuuggggaaaguaauauagugauuggaauuggagacaacgccuugaaaaucaacugguauaagaaaggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaccuccuguggaagcaaauagccaaugaacugaacuacauauugugggaaaacaauaucaaauuaacggugguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacauaggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuagggguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacacugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcagauagaguaaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugaaccagaaagggagaagucagccgccauagacggugaguaucgcuugaaaggugaguccaggaagacuuucguggaacucaugaggaggggugaccuuccagucugguuagcccacaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauagagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaagucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugccuugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7200 - RNA, 9873 nt, Artificial Sequence
  derived and/or modified CDS sequence (wt) from DENV-3__JX669504__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaccaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauauuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuucguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacgcuugugcuccuucucucagggcaaauaacauggagagacauggcgcacacacuaauaaugauuggguccaacgcaucugacaggaugggaaugggcguuaccuaccuagcuuuaauugcaacauucaaaauccagccauucuuggcuuugggauuuuuucuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauucuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuuguaagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaggucauugccguagagccuggaaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacguuagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugcuugcgaaaaaacgggaaaaaggucauucagcuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacucacauuggcugcaauaauagcagcuaaugaaaugggauugcuggaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagccguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacacgguaucuagacugcuacugaacagguucacgaugacacacagaagacccaccacugagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagggaccucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7201 - RNA, 9873 nt, Artificial Sequence
  derived and/or modified CDS sequence (wt) from DENV-3__JX669506__SS-prME
acaucguucugucucaugaugauauugccagcagcacuugcuuuccacuugacuucacgagauggagagccgcgcaugauaguggggaagaaugaaagaggaaaaucccuacuuuuuaagacagccucuggaaucaacaugugcacacucauagccauggaccugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggagguacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcuuacaauggcagacugauuacagccaacccaguggugacuaagaaggaggagccugucaauauugaggcugaacccccuuuuggggaaaguaauauagugauuggaauuggagacaacgccuugaaaaucaacugguauaagaaaggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaccuccuguggaagcaaauagccaaugaacugaacuacauauugugggaaaacaauaucaaauuaacggugguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuagggguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacacugcuggucuggcauacuuggcaaaagcaaacccaaagauccggcguucuaugggacguacccagccccccagagacacagaaagcagaacuugaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccagcauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcagauagaguaaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccacaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauuuaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacuguaauagagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggauguuauuggggaaagaauaaaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaagucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuggcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaucaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7202 - RNA, 9873 nt, Artificial Sequence
  derived and/or modified CDS sequence (wt) from DENV-3__JX669496__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaccaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauauuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaaaauggacaaauuggaacucaaggggaugagcuaugcaaugugcgcgaauaccuucguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgauaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcgggggugcucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauucuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggagugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaggucauugccguagagccuggaaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugcuugcgaaaaaacgggaaaaaggucauucagcuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacucacauuggcugcaauaauagcagcuaaugaaaugggauugcuggaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacgucaugggccuugugugaagcuuuaacucuagcuacaggaccaauaacaacacucugggaaggaucaccugggaaguuuuggaacaccacgauagccguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacacgguaucuagacugcuacugaacagguucacgaugacacacagaagacccaccacugagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcucuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7203 - RNA, 9873 nt, Artificial Sequence
  derived and/or modified CDS sequence (wt) from DENV-3__JX669490__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugucuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagacccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7204 - RNA, 9873 nt, Artificial Sequence
  derived and/or modified CDS sequence (wt) from DENV-3__JN406515__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagcuauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccaaaccuggaugucggcugaaggagcuuggagacaagucgagaagguagaaacaugggcuuuuagacacccaggguucacaauacuagcccuauuucuugcccacuacauaggcacuuccuugacccagaaaguggucauuuucauacuacuaaugcuggucaccccauccaugacaaugagaugugugggaguaggaaacagagauuucguggaaggucuaucaggagcuacauggguugacguggugcucgaacauggugggugugugacuaccauggcuaagaacaagcccacgcuggacauagagcuccagaagaccgaggccacccaacuggcaacccuaaggaaacuaugcauugagggaaaaaucaccaacgugacaaccgacucaaggugccccacccaaggggaagcgauucuaccugaggagcaagaccagaacuacguguguaagcacacauacguggacagaggcuggggaaacgguugugguuuguuuggcaagggaaguuugguaacaugcgcgaaauuucaaugucuggaauuaauagagggaaaagugguucagcaugagaaccucaaauacaccgucaucaucacagugcauacaggagaccaacaccaggugggaaaugaaacgcagggagucacggcugaaauaacaccccaggcaucaaccgucgaagccaucuuaccugaauauggaacccuugggcuagaaugcucaccacggacagguuuggauuucaaugaaaugaucuuguugacaaugaagaacaaagcauggauggugcauagacaaugguuuuuugaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagcuacagagauccaaaccucgggaggcacaaguaucuuugcgggacacuugaaaugcagacucaagauggacaaacuggaacucaaggggaugagcuaugcaaugugcucaaaugccuuuguguugaagaaagaagucucugaaacacaacaugggacaauacucauuaaggucgaguacaaaggggaagacgcaccuugcaagaucccuuucuccacggaggaugaacaagggaaagcccacaauggcagacugaucacggcuaacccaguggugaccaagaaggaagagccugucaauauugaggcagaacccccuuuuggggaaaguaacauaauaauuggaauuggagacaaagccuugaaaaucaauugguacaagaagggaagcucgauugggaagauguucgaggccacugccaggggugcaaggcgcauggccaucuugggagacacagccugggacuuuggaucaguaggugguguuuuaaauucacuggggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaauuggaaaggcaaagaacucaaauguggaaguggaauuuucguuacuaaugagguccacacuuggacagagcaauacaaauuucaagcagacucccccaaaagacuggcgacagccauugcaggcgccugggagaauggagugugcggaaucaggucgacaaccagaauggagaaccucuuguggaagcaaauagcuaaugaacuaaacuacauauuaugggaaaacaacaucaaauuaacgguaguugugggugacauaauuggggucuuagaacaagggaaaagaacacuaacaccacaacccauggagcuaaaauauucauggaaaacauggggaaaagcgaaaauagugacagcugaaacacaaaauuccuccuuuauaauagaugggccaaacacaccagaguguccaaaugccucaagagcauggaaugugugggagguggaagauuacggguucggagucuucacaacuaauauauggcugaagcuccgagagauguacacucaacuaugugaccacaggcuaaugucggcagccguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuggagagugacaugaucaucccaaagagucuggcugguccuaucucgcaacacaacuacaggccuggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagauggcugcugguauggcauggaaauuagacccauuaaugagaaagaagagaacaugguaaagucuuuagucucagcagggaguggaaagguggauaacuucacaaugggcguccugugucuugcaauccucuucgaagagguaaugagagggaaauucggaaaaaagcacaugauugcagggguucucuucacauuugugcuccuccucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauuggggguuggguuggccauggcaacaacguugcaacugccagaggacguugaacaaauggcgaauggaauagccuuggggcucauggcucuuaaauugauaacacaauuugaaacauaccaacuauggacggcauuagucucccuaauguguucaaacacaauuuucacguugacuguugccuggagaacagccacccugauuuuggccggaauuucgcuuuuuccagugugccagucuucgagcaugaggaaaacagauuggcucccaaugacuguggcagcuaugggaguuccaccuuuaccacuuuuuauuuucaguuugaaagacacacucaaaaggagaagcuggccacugaaugagggggugauggccguuggacuugugaguauccuagcaaguucucuccuuaggaaugacguacccauggcuggaccauuaguggcugggggcuugcugauagcgugcuacgucauaacuggcacgucagcagaccucacuguagaaaaagcagcggaugugacaugggaggaagaagcugagcaaacaggagugucccacaaucuaaugaucacaguugaugaugauggaacaaugagaauaaaagaugaugagacugagaacaucuuaacagugcuuuugaaaacagcacuacuaauagugucaggcauuuuuccauacuccauaccugcaacacuucugguuuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccacacuauguggcacgucacaagaggagcaguguugacauacaauggaaaaagauuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuuuaagccuggaacuucaggaucuccuaucauaaacagagagggaaagguagugggacuauauggcaauggagugguuacaaagaaugguggcuaugucaguggaauagcucaaacaaacgcagaaccagacggaccgacaccagaguuggaagaagagauguucaaaaagcgcaaucuaaccaugauggaucuccaucccgggucaggaaagacgcggaaauaccucccagccauaguuagagaggcaaucaagagacgcuuaaggacucuaauuuuggcaccaacaagggugguugcagcugagauggaagaagcacugaaagggcucccaauaagguaucaaacaaccgcaacaaaaucugaacacacagggaaagagauuguugaucuaaugugccacgcaacguucacaaugcguuugcugucaccagucagaguuccaaacuacaacuugauaauaauggaugaggcucauuucacagacccagccaguauagcagcuagaggguacauaucaacucguguaggaaugggagaggcagccgcaauuuucaugacggccacaccuccuggaacagcugaugccuuuccucagagcaacgcuccaauucaagaugaagaaagagacauaccagaacgcucauggaauucaggcaaugauuggauuaccgacuuugcuggaaagacugugugguuuguccccagcaucaaagcugggaaugacauagcaaacugcuugcggaaaaauggaaaaaaggucauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacggacggacccgagcgcgugauccuggcgggaccaaugccagucaccguagcgagugcugcgcaaaggagagggagaguuggcagaaacccacaaaaagaaaaugaccaauacauauucacgggccagccccucaacaaugaugaagaccacgcucacuggacagaagcgaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauucuagaggaaaauauggauguggaaaucuggacaaaggaaggagaaaagaaaaaauugaggccuagguggcuugaugcccgcacuuauucagaucccuuagcgcucaaagaauucaaggacuuugcggcugguagaaagucgaucgcccuugaucuugugacagaaauaggaagagugccuucacaucuagcccacagaacgagaaacgcucuggacaaucuggugauguugcacacaucagaacacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauaguccuggaguucuuuaugaugguguuacuuauaccagaaccagaaaaacagagaacuccccaagacaaucaacucgcauaugucgugauaggcauacuuacauuggcugcaauaguagcagccaaugaaaugggauuguuggaaaccacaaagagagauuuggggauguccaaagaaccagguguuguuucgccaaccaguuauuuggauguggauuuacacccagcaucagccuggacauuguacgcuguggccacaacaguaauaacaccaauguugagacauaccauagagaauuccacagcaaaugugucccuagcagcuauagccaaccaggcagugguccugauggguuuagacaaaggauggccgauaucgaaaauggacuuaggcgugccacuauuggcacuggguugcuauucacaagugaacccacuaacucucacagcggcaguacuccugcuagucacgcauuaugcuauuauagguccaggauugcaggcaaaagcuacucgugaggcucaaaaaaggacggcugcuggaauaaugaagaauccaacgguggaugggauaaugacaauagaccuagauccuguaauauacgacucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuuccauggcaaacaucuuuagagggagcuaucuggcaggagcugggcuagcuuuuucuaucaugaaaucaguuggaacaggaaagagaggaacagggucacaaggugaaacuuugggagaaaaguggaaaaagaaacugaaucaauuaucccggaaagaguuugaccucuacaagaaauccggaaucacugaaguggauagaacagaagccaaagaaggguugaaaagaggagaaauaacacaccaugccguauccagaggcagcgcaaaacuccaaugguucguggagagaaacauggucauuccugaaggaagagucauagacuugggcuguggaagaggaggcuggucauauuacugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagagagcagaaccauaagagucuugaaaaugguugaaccauggcuaaaaaauaaccaguuuugcauuaaaguauugaauccuuauaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauaggagacccaccauagagaaagauguggauuuaggagcggggacccgacaugucaaugcggaaccagaaacacccaacauggaugucauuggggaaagaauaagaagaaucaaggaggagcacaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuucaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacggaggagaaccaaugggacagcgcuagagccgccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccacugguucucgcgugaaaacucuuacaguggaguagaaggggaaggacugcauaagcugggauauaucuugagagauauuuccaagauaccuggaggagccauguaugcugaugacacagcugggugggacacaagaauaacagaagaugaccugcacaaugaggaaaaaaucacacagcaaauggacccugaacacaggcaguuagcaaacgcuauauuuaagcucacauaccaaaauaaaguggucaaaguucaacgaccaacuccaaagggcacgguaauggacaucauaucuaggaaagaccaaagaggcaguggacaggugggaacuuauggucugaauacauucaccaacauggaagcccagcugaucagacaaauggaaggagaagguguguugucgaagacagaccucgagaacccucaucuacuagagaagaaaauuacacaaugguuggaaaccaaaggaguggagagguuaaaaagaauggccaucagcggggaugauugcguggugaaaccaaucgacgacagguucgcuaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauugauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagauaugcuuacuguuuggaacaggguauggauagaggacaauccauggauggaagacaaagcuccagucacaacuugggaagauguuccauaucuagggaagagagaggaccaauggugcggaucacucauuggucucacuuccagagcaaccugggcccagaacauacuuaccgcaauccaacagguaagaagccuuauagguaaugaagaguuucuggacuacaugccuucuaugaagagauucaggaaggaggaggagucagagggagccauuugguaa

SEQ ID NO: 7205 - RNA, 9873 nt, Artificial Sequence
  derived and/or modified CDS sequence (wt) from DENV-3__JN406514__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuauggaacgugcaaccaagcuggggagcacagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcaauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguuccuugaccuaccccuaccauggacaucaggagcuacaacagagagaccaacuuggaacaggaaagagcuucuuguaacauucaaaaaugcacaugcgaaaaagcaagaaguaguuguccuuggaucacaagagggagcaaugcacacagcgcugacaggagcuacagagauucaaaacucaggagguacaagcauuuuugcggggcacuugaaauguagacuuaagauggacaaauuggaacucaaggggaugagcuaugcaauguguuugaauaccuuuguguugaagaaagaagucuccgaaacgcagcaugggacaauacucauuaagguugaguacaaaggggaagaugcaccuugcaagaucccuuucuccacagaggauggacaagggaaagcccacaaugguagacugaucacagccaacccaguggugaccaagaaggaggagccugucaauauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuaggaaaaauggugcaccaaauauucggaagugcuuacacagcccuguuuagcggagucucauggauaaugaaaauuggaauagguguccucuuaaccuggauagggcugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacacaauuggggucuuagagcaagggaaaagaacacuaacaccacagcccauggagcuaaaauacucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucucaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaacuuguauuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaaaucuuuagucucagcagggaguggaaaaguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcucuugccacugugccagucuucgagcaugaggaaaacagauuggcucccaaugacuguggcagcuaugggaguuccacccuuaccacuuuuuauuuucagcuugaaggacacacccaaaaggagaagcuggccacugaaugagggagugauggcuguugggcuugugagcauucuagcuaguucucuccuuaggaaugaugugcccauggcuggaccauuaguggccgggggcuuguugauagcgugcuaugucauaacuggcacgucagcagaccucacuguagaaaaagcagcagauguaacaugggaggaagaggcugagcaaacagggguaucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggauguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaaaggagaggaggugcagguuauugccguagagccugggaagaacccaaaaaacuuucaaaccaugccgggcauuuuucagacaacaacaggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugaaauggaagaagcacugaaaggacucccaauaagguaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggaccugagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagagagaagucagccgcuauagacggugaauaccgccuaaagggugaguccaggaagaccuucguggaacucaugaggaggggugaccucccaguuuggcuagcccacaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacugccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcaucggcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacccucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucugacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagagucuucaccaagcccaacaguggaagaaagcagaacuauaagaguuuugaagaugguugagccauggcuaaaaaacaaccaguuuugcauuaaaguauuaaacccuuacaugccaaccgugauugagcaccuagaaagacuacaaagaaaauauggaggaaugcuugugagaaacccacucucacgaaacuccacgcaugaaauguacuggauauccaaugguaccggcaacauugucucuucagucaacaugguauccagauugcuacugaacagauucacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacaccuaggcccaugccagggacaagaaaggucauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauuaggcaaguguggaagcugcgucuacaacaugaugggcaagagagagaagaaacuuggagaguuuggcaaagcaaaaggcaguagagcuauaugguacaugugguuaggagccagguaccuugaguucgaagcacucggguuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacaaacaauuagcgaacgccauauuuaagcucacauaccaaaacaaaguggucaaaguccaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuagaaaccaaaggaguggagagauuaaaaagaauggccaucagcggggaugauugcguggugaaaccgaucgaugacagguuugccaaugcccugcuugcccugaaugacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7206 - RNA, 9873 nt, Artificial Sequence
  derived and/or modified CDS sequence (wt) from DENV-3__KT726340__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaggaugaugagacugagaauaucuuaacagugcuuuugaaaacagcauuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugauuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaauauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauuggguaaguguggaagcuguguuuacaacaugaugggcaagagagagaagaaacuuggagaguuuggcaaagcaaaaggcaguagagcuauaugguacaugugguugggagccagguaccuugaguucgaagcccucggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccaaucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7207 - RNA, 9873 nt, Artificial Sequence
  derived and/or modified CDS sequence (wt) from DENV-3__KT726345__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuauggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaauaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacacaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaagguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguuaggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcucugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7208 - RNA, 9873 nt, Artificial Sequence
  derived and/or modified CDS sequence (wt) from DENV-3__KT726349__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaguauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7209 - RNA, 9873 nt, Artificial Sequence
  derived and/or modified CDS sequence (wt) from DENV-3__KT726347__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuagcaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggccugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccaguaauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucaccgaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuugggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguuaggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7210 - RNA, 9873 nt, Artificial Sequence
  derived and/or modified CDS sequence (wt) from DENV-3__KT726352__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagauaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuugcugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccgccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7211 - RNA, 9873 nt, Artificial Sequence
  derived and/or modified CDS sequence (wt) from DENV-3__KT726356__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacuaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuacuggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcgcaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacagacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacauacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7212 - RNA, 9873 nt, Artificial Sequence
  derived and/or modified CDS sequence (wt) from DENV-3__KT726342__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcucuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuucugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagcuaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugauacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7213 - RNA, 9873 nt, Artificial Sequence
  derived and/or modified CDS sequence (wt) from DENV-3__KT726343__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacugccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggagugcccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaagagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7214 - RNA, 9873 nt, Artificial Sequence
  derived and/or modified CDS sequence (wt) from DENV-3__KT726351__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacguauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaaggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7215 - RNA, 9873 nt, Artificial Sequence
  derived and/or modified CDS sequence (wt) from DENV-3__KT726360__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuccagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacaaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaagaacacaucuaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaauuuuuccauacuccauacccgccacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggagaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggacccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugccauuauagguccaggauugcaggcaaaagccacucgugaggcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7216 - RNA, 9873 nt, Artificial Sequence
  derived and/or modified CDS sequence (wt) from DENV-3__KF041259__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaacgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaguuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugcuuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucaucacacucuaccugggagcugugguacaagcugacauggggugugucauaaacuggaaaggcaaagaacuuaaauguggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcaaauagccaaugaacucaacuacauauuaugggaaaacaauaucaaauuaacgguaguugugggcgacacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccagaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaagauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggagaucagacccaucagugagaaagaagagaacaugguaaagucuuuagucucagcgggaaguggaaagguagacaauuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuuaggauuuuuccuaagaaaacugacaucuagagaaaauuuacuguuaggaguuggacuggcuauggcaacaacauuacaacugccagaggacauugaacaaauggcaaauggaaucgcccuggggcucauggcucuuaaauugauaacacaauuugaaacauaucaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagccaugggagucccaccccuaccacucuuuauuuuuagcuugaaagacacacucaaaaggagaagcuggccgcugaaugaaggggugauggcuguugggcuugugagcauuuuggccaguucucuccuuagaaaugacgugcccauggcuggaccauuaguggccgggggcuugcugauagcaugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguccuaugggacguacccagucccccagagacacagaaagcagaacuggaggaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaaacgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacgggaagagagauuguugaucuaaugugccacgcaacguucacaaugcgcuugcugucaccaguuaggguuccaaauuacaacuugauaauaauggaugaggcucauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauagaaaauggugcuuugauggacagcgcaacaaucaaauuuuagaggaaaacauggauguggaaaucuggacaaaggaaggagaaaagagaaaauuaagaccuagguggcuugaugcccgcacuuauucagaucccuuagcacucaaggaauucaaggacuuugcggcuggcagaaagucaaucgcccuugaccuugugacagaaauaggaagagugccuucacaccuagcccacagaacgagaaacgcucuggacaaucuggugaugcugcacacgucagaacauggcgguagggccuacaggcaugcgguggaggaacugccagaaacaauggaaacacuccuacucuugggacucaugaucuuacugacagguggagcaaugcuuuucuugauaucagguaaagggauuggaaagacuucaauaggacucauuugugugauugcuucuagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcggccaaugaaaugggacugcuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucugacagcggcaguacuucugcuaauuacacauuaugcuauuauagguccaggacugcaggcaaaagccacucgugaagcucaaaaaaggacagcugcuggaauaaugaagaauccaacgguggaugggauaauaacaauagaccuagauccgguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaagaagaaauugaaucaauuaucccggaaagaguuugaccuuuacaagaagucuggaaucacugaaguggauagaacagaagccaaagaaggguugaaaagaggagaaacaacacaucaugccguguccagagguagugcaaaacuucaaugguuuguggagaggaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuauuacugaacagguucaagaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagauacaacuccauuuggccagcagagagucuuuaaagagaaaguggacaccaggacacccaggcccaugccagggacaagaaagguuauggagaucacagcggaguggcucuggagaacccuggggaggaacaaaagacccagguuaugcacaagggaagaguuuacaaaaaaggucagaaccaacgcagccaugggcgccguuuucacagaggagaaccaaugggacagugcgaaagcugcuguugaggaugaagaauuuuggaaacucguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguucccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaguggugcggaucacuuauuggucucacuuccagagcaaccugggcccagaacauacccacagcaauucaacaggugagaagccuuauaggcaaugaagaguuucuggauuacaugccuucaaugaagagauucaggaaggaggaggaguuggagggagccauuugguaa

SEQ ID NO: 7217 - RNA, 9873 nt, Artificial Sequence
  derived and/or modified CDS sequence (wt) from DENV-3__KF041258__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagcuauggacuugggagagaugugugaugacacggucacuuacaaaugcccccacauuaccgaaguggaaccugaagacauugacugcuggugcaaccuuacaucaacaugggugacuuauggaacgugcaaucaagcuggggagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccacuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcaaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaacaccuuuguguugaagaaagaagucucagaaacgcagcaugggacaauacucauuaaggucgaguacaaaggggaagaugcaccuugcaagauuccuuucuccacggaggauggacaagggaaagcucacaauggcagacugaucacagccaacccaguggugacuaagaaggaggagccuguuaacauugaggcugaaccuccuuuuggggaaagcaauauaguaauuggaauuggagacaaugcuuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucuccugacuuggauaggguugaauucaaaaaacacauccaugucauuuucauguauugcgauaggaaucaucacacucuaucugggagcugugguacaagcugacauggggugugucauaaacuggaaaggcaaagaacuuaaauguggaaguggaauuuucgucaccaacgagguccauaccuggacagagcaguacaaauuccaagcggacuccccaaaaagauuggcgacagcuauugcaggcgcuugggaaaauggagugugcggaauuaggucaacaaccagaauggagaaccucuuguggaagcaaauagccaaugaacugaauuacauauuaugggaaaacaauaucaaauuaacgguaguugugggcgacacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccagaguguccaagugccucaagagcauggaaugugugggagguggaagauuacggguucggagucuucacaaccaacauauggcugaaacuccgagagguauacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggagaucagacccaucagugagaaagaagagaacaugguaaagucuuuagucucagcgggaaguggaaagguagacaacuucacaaugggcgucuuguguuuggcaauccucuuugaagaggugaugagaggaaaauuugggaagaaacacaugauugcagggguuuucuucacguuugugcuccuucucucagggcaaauaacguggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacauuacaacugccagaggacauugaacaaauggcaaauggaaucgcccuggggcucauggcucuuaaauugaugacacaauuugaaacauaucaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagccaugggagucccaccccuaccacucuuuauuuucagcuugaaagacacacucaaaaggagaagcuggccgcugaaugaaggggugauggcuguugggcuugugagcauucuggccaguucucuccuuagaaaugacgugcccauggcuggaccauuaguggccgggggcuugcugauagcaugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguucuaugggacguacccagucccccagagacacagaaagcagaacuggaggaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuaucgccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaaacgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaaggucucccaauaagguaccaaacaacagcaacaaaaucugaacacacgggaagagagauuguugaucuaaugugccacgcaacguucacaaugcgcuugcugucaccaguuaggguuccaaauuacaacuugauaauaauggaugaggcucauuucacagacccagccaguauagcggccagaggguacauaucaacucguguuggaaugggagaggcagccgcaauuuucaugacggcaacacccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgcuauagacggugaauaucgccugaagggugaauccaggaagacuuucguggaacucaugaggaggggugaccuuccaguuugguuagcccacaaaguagcaucagaagggaucaaauauacagauagaaaauggugcuuugauggacagcgcaacaaucaaauuuuagaggaaaacauggauguggaaaucuggacaaaggaaggagaaaagagaaaauuaagaccuagguggcuugaugcccgcacuuauucagaucccuuagcacucaaggaauucaaggacuuugcggcuggcagaaagucaaucgcccuugaccuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagguauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacugcuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuucugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaauuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguuaaaaagaggagaaacaacacaucaugccguguccagagguagugcaaaacuucaaugguuuguggagagaaacauggucauuccugaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacaucgucucuucagucaacaugguauccagauuauuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaauggaguugugaaacuucuuacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggcgccguuuuuacagaggagaaccaaugggacagugcgaaagcugcugucgaggaugaagaauuuuggaaacuuguggacagagaacgugaacuccacaaauugggcaaguguggaagcugcguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacucuuacaguggaguagaaggagaaggacugcacaaacuaggcuacguauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaauauggaagcccaguuagucagacaaauggaaggagaaggugugcugucaaaggcagaccucgagaacccucaucugccagaaaagaagauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaacugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucaccuccagagcaaccugggcccagaacauacccacagcaauucaacaggugagaagccuuauaggcaaugaagaguuucuggauuacaugccuucaaugaagagauucaggaaggaggaagaguuggagggagccauuugguaa

SEQ ID NO: 7218 - RNA, 9873 nt, Artificial Sequence
  derived and/or modified CDS sequence (wt) from DENV-3__KF041257__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagcuauggacuugggagagaugugugaugacacggucacuuacaaaugcccccacauuaccgaaguggaaccugaagacauugacugcuggugcaaccuuacaucaacauggguaacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccacuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacggaggauggacaagggaaagcucacaauggcagacugaucacagccaacccaguggugacuaagaaggaggagccuguuaacauugaggcugaaccuccuuuuggggaaagcaauauaguaauuggaauuggagacaaugcuuugaaaaucaacugguacaagaagggaagcucuauuggaaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucauguauugcgauaggaaucaucacacucuaucugggagcugugguacaagcugacauggggugugucauaaacuggaaaggcaaagaacuuaaauguggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcaaauagccaaugaacugaacuacauauuaugggaaaacaauaucaaauuaacgguaguugugggcgacacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccagaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggagaucagacccaucagugagaaagaagagaacaugguaaagucuuuagucucagcgggaaguggaaagguagacaacuucacaaugggcgucuuguguuuggcaauccucuuugaagaggugaugagaggaaaauuugggaagaaacacaugauugcagggguuuucuucacguuugugcuccuucucucagggcaaauaacguggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacauuacaacugccagaggacauugaacaaauggcaaauggaaucgcccuggggcucauggcucuuaaauugauaacacaauuugaaacauaucaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagccaugggagucccaccccuaccacucuuuauuuuuagcuugaaagacacacucaaaaggagaagcuggccgcugaaugaaggggugauggcuguugggcuugugagcauucuggccaguucucuccuuagaaaugacgugcccauggcuggaccauuaguggccgggggcuugcugauagcaugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguucuaugggacguacccagucccccagagacacagaaagcagaacuggaggaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcguaaaaaaagaucugauuucauacggaggaggauggagauugagcgcacaauggcaaaagggggaggaggugcagguuaucgccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaaacgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacgggaagagagauuguugaucuaaugugccacgcaacguucacaaugcgcuugcugucaccaguuaggguuccaaauuacaacuugauaauaauggaugaggcucauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugccgcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauagaaaauggugcuuugauggacagcgcaacaaucaaauuuuagaggaaaacauggauguggaaaucuggacaaaggaaggagaaaagagaaaauuaagaccuagguggcuugaugcccgcacuuauucagaucccuuagcacucaaggaauucaaggacuuugcggcuggcagaaagucaaucgcccuugaccuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcucuucuugauaucagguaaagguauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacugcuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuucugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguccaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuacgagaaaaauggaaaaagaaauugaaucaauuaucccggaaagaguuugaccuuuacaagaagucuggaaucacugaaguggauagaacagaagccaaagaaggguuaaaaagaggagaaacaacacaucaugccguguccagagguagugcaaaacuucaaugguuuguggagagaaacauggucauuccugaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacaucgucucuucagucaacaugguauccagauuauuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcgaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggcgccguuuuuacagaggagaaccaaugggacagugcgaaagcugcuguugaggaugaagaauuuuggaaacuuguggacagagaacgugaacuccacaaauugggcaaguguggaagcugcguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaauauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuuuugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucaccuccagagcaaccugggcccagaacauacccacagcaauucaacaggugagaagccuuauaggcaaugaagaguuucuggauuacaugccuucaaugaagagauucaggaaggaggaggaguuggagggagccauuugguaa

SEQ ID NO: 7219 - RNA, 9873 nt, Artificial Sequence
  derived and/or modified CDS sequence (wt) from DENV-3__KF041255__SS-prME
acaucgcucugucucaugaugauauugccagcagcacuugcuuuccacuugacuucacgaaauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugcuuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucaucacacucuaucugggagcugugguacaagcugacauggggugugucauaaacuggaaaggcaaagaacuuaaauguggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcaaauagccaaugaacucaacuacauauuaugggaaaacaauaucaaauuaacgguaguugugggcgacacaauaggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccagaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacauacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggagaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacauuacaacugccagaggacauugaacaaauggcaaauggaaucgcccuggggcucauggcucuuaaacugauaacacaauuugaaacauaucaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagccaugggagucccaccccuaccacucuuuauuuuuagcuugaaagacacacucaaaaggagaagcuggccgcugaaugaaggggugauggcuguugggcuugugagcauucuggccaguucucuccuuagaaaugacgugcccauggcuggaccauuaguggccgggggcuugcugauagcaugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguucuaugggacguacccagucccccagagacacagaaagcagaacuggaggaaggggucuauaggauuaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaaacgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacgggaagagagauuguugaucuaaugugccacgcaacguucacaaugcgcuugcugucaccaguuaggguuccaaauuacaacuugauaauaauggaugaggcucauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugauugacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauagaaaauggugcuuugauggacagcgcaacaaucaaauuuuagaggaaaacauggauguggaaaucuggacaaaggaaggagaaaagagaaaauuaagaccuagguggcuugaugcccgcacuuauucagaucccuuagcacucaaggaauucaaggacuuugcggcuggcagaaagucaaucgcccuugaccuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacugcuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuucugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuauuacugaacagguucaagaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguugugcacaagggaagaguuuacaaaaaaggucagaaccaacgcagccaugggcgccguuuucacagaggagaaccaaugggacagugcgaaagcugcuguugaggaugaagaauuuuggaaacucguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggauuacaugccuucaaugaagagauucaggaaggaggaggaguuggagggagccauuugguaa

SEQ ID NO: 7220 - RNA, 9873 nt, Artificial Sequence
  derived and/or modified CDS sequence (wt) from DENV-3__KF041256__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagacugaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggauuucaaugaaaugauccuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacuuauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaagcaauauaguaauuggaauuggagacaaugcuuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucaucacacucuaucugggagcugugguacaagcugacauggggugugucauaaacuggaaaggcaaagaacuaaaauguggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcaaauagccaaugaacucaacuacauauuaugggaaaacaauaucaaauuaacgguaguugugggcgacacaauuggggucuuagagcaagggaaaagaacacuaacaccacaacccauggagcuaaaauacucauggaaaacguggggaaaggcaaaaauagugacagcugaaacacaaaauuccucuuucauaauagacgggccaaauacaccagaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggaacuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggagaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacauuacaacugccagaggacauugaacaaauggcaaauggaaucgcccuggggcucauggcucuuaaauugauaacacaauuugaaacauaucaauuauggacggcauuaaucuccuuaacguguucaaauacaauuuucacguugacuguugccuggagaacagccacccugauuuuggccggaguuucacucuuaccagugugccagucuucgagcaugaggaaaacagacuggcuuccaaugacaguggcagccaugggagucccaccccuaccacucuuuauuuuuagcuugaaagacacacucaaaaggagaagcuggccgcugaaugaaggggugauggcuguugggcuugugagcauucuggccaguucucuccuuagaaaugacgugcccauggcuggaccauuaguggccgggggcuugcugauagcaugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguucuaugggacguacccagucccccagagacacagaaagcagaacuggaggaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagaaauguucaaaaaacgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacgggaagagagauuguugaucuaaugugccacgcaacgcucacaaugcgcuugcugucaccaguuaggguuccaaauuacaacuugauaauaauggaugaggcucauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauagaaaauggugcuuugauggacagcgcaacaaccaaauuuuagaggaaaacauggauguggaaaucuggacaaaggaaggagaaaagagaaaauuaagaccuagguggcuugaugcccgcacuuauucagaucccuuagcacucaaggaauucaaggacuuugcggcuggcagaaagucaaucgcccuugaccuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacugcuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuucugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaaaaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagcugugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuauuacugaacagguucaagaugacacacaggagaccuaccauagagaaagauguggauuuaggagcaggaacucgacauguuaaugcggaaccagaaacacccaacauggaugucaucggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggcgccguuuucacagaggagaaccaaugggacagugcgaaagcugcuguugaggaugaagaauuuuggaaacucguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacucuuacaguggaguggaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaaggggcaguggacaggugggaacuuauggucugaauacauucaccaacauggaagcccagcuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaauccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaaugucccauaccuagggaagagagaagaccaauggugcggaucacuuauuggucucacuuccagagcaaccugggcccagaacauacccacagcaauucaacaggugagaagccuuauaggcaaugaagaguuucuggauuacaugccuucaaugaagagauucaggaaggaggaggaguuggagggagccauuugguaa

SEQ ID NO: 7221 - RNA, 9873 nt, Artificial Sequence
  derived and/or modified CDS sequence (wt) from DENV-3__KF041254__SS-prME
acaucgcucugucucaugaugauauuaccagcagcacuugcuuuccacuugacuucacgagauggagagccgcgcaugauuguggggaagaaugaaagaggaaaaucccuacuuuuuaagacagccucuggaaucaacaugugcacacucauagcuauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaacuuggaugucggcugaaggagcuuggagacaagucgagaagguagagacaugggcccuuaggcacccaggguucaccauacuagcccuauuucuugcccacuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacggaggauggacaagggaaagcucacaauggcagacugaucacagccaacccaguggugacuaagaaggaggagccuguuaacauugaggcugaaccuccuuuuggggaaagcaauauaguaauuggaauuggagacaaugcuuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucauguauugcgauaggaaucaucacacucuaucugggaguugugguacaagcugacauggggugugucauaaacuggaaaggcaaagaacuuaaauguggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaccucuuguggaagcaaauagccaaugaacugaauuacauauuaugggaaaacaauaucaaauuaacgguaguugugggcgacacaauuggggucuuagagcaaggaaaaagaacacuaacaccacaacccauggagcuaaaauacucauggagaacguggggaaaggcaaaaauagugacagcugaaacacaaaauuccucuuucauaauagacgggccaaacacaccagaguguccaagugccucaagagcauggaaugugugggagguggaagauuacggguucggagucuucacaaccaacauauggcugaaacuccgagagauguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggagaucagacccaucagugagaaagaagagaacaugguaaagucuuuagucucagcgggaaguggaaagguagacaacuucacaaugggcgucuuguguuuggcaauccucuuugaagaggugaugagaggaaaauuugggaagaaacacaugauugcagggguuuucuucacguuugugcuccuucuuucagggcaaauaacguggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacauuacaacuaccagaggacauugaacaaauggcaaauggaaucgcccuggggcucauggcucuuaaauugauaacacaauuugaaacauaucaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagccaugggagucccaccccuaccacucuuuauuuuuagcuugaaagacacacucaaaaggagaagcuggccgcugaaugaaggggugauggcuguugggcuugugagcauucuggccaguucucuccuuagaaaugacgugcccauggcuggaccauuaguggccgggggcuugcugauagcaugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguucuaugggacguacccagucccccagagacacagaaagcagaacuggaggaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuaucgccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaaacgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacgggaagagagauuguugaucuaaugugccacgcaacguucacaaugcgcuugcugucaccaguuaggguuccaaauuacaacuugauaauaauggaugaggcucauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguugguaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauagaaaauggugcuuugauggacagcgcaacaaucaaauuuuagaggaaaacauggauguggaaaucuggacaaaggaaggagaaaagagaaaauuaagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaacgcuuuucuugauaucagguaaagguauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacugcuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuucugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaauauuuuuagagggagcuauuuagcacgagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguuaaaaagaggagaaacaacacaucaugccguguccagagguagugcaaaacuucaaugguuuguggagagaaacauggucauuccugaagggagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacaucgucucuucagucaacaugguauccaaauuauuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaacucaacauggcacuaugaugacgaaaaccccuacaaaacgugggcuuaccacggaucuuaugaagucaaggccacaggcucagccuccuccaugauaaauggagucgugaaacuucuuacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaagaaacaaaagacccagguuaugcacaagggaagaguuuacaaaaaaggucagaaccaacgcagccaugggcgccguuuuuacagaggagaaccaaugggacagugcgaaagcugcuguugaggaugaagaauuuuggaaacuuguggacagagaacgugaacuccacaaauugggcaaguguggaagcugcguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgcgaaaacucuuacaguggaguagaaggagaaggacugcacaaacuaggcuacauauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaauauggaagcccaguuagucagacaaauggaaggagaaggugugcugucaaaggcagaccucgagaacccucaucugccagaaaagaagauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccucaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucaccuccagagcaaccugggcccagaacauacccacagcaauucaacaggugagaagccuuauaggcaaugaagaguuucuggauuacaugccuucaaugaagagauucaggaaggaggaagaguuggagggagccauuugguaa

SEQ ID NO: 7222 - RNA, 9873 nt, Artificial Sequence
  derived and/or modified CDS sequence (wt) from DENV-3__KX380841__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagaaaugugugaugacacggucacuuacaaaugcccccacauuaccgaaguggaaccugaagacauugacugcuggugcaaccuuacaucaacaugggugacuuauggaacguguaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcauccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaauauaacaacugacucaagaugucccacccaaggggaagcgguuuugccugaggagcaggaccagaacuacguguguaagcacacauacguagauagaggcugggggaacgguugugguuuguuuggcaagggaagcuugguaacaugugcgaaauuucaaugccuggaaccgauagagggaaaaguagugcaauaugagaaccucaaauacaccgucaucauuacagugcacacaggagaccaacaccaggugggaaaugaaacgcagggaaucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagccacaacagaaacaccaacuuggaacaggaaggagcuccuugugacauucaaaaaugcacaugcgaaaaaacaagaagugguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaacauugaggcugaaccuccuuuuggggaaaguaauauaguaauuggaauuggagacaaugccuugaaaaucaauugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuuaacuuggauaggguugaauucaaaaaacacauccaugucauuuucaugcauugcaauaggaaucaucacacucuauuugggagcugugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauugcaggcgcuugggaaaauggaguguguggaauuaggucaacaaccagaauggagaaucucuuguggaagcaaauagccaaugaacugaacuacauauuaugggaaaacaacaucaaauugacgguaguugugggcgacacaaucgggguuuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuacuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaauugugggacaagaggcccaucauugagaacgacaacagugucaggaaaguugauacaugaaugguguugccgcucgugcacacuuccuccccugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacguuacaauugccagaggacauugaacaaauggcaaauggaaucgcccuggggcucauggcucuuaaauugauaacacaauuugaaacauaccaauuauggacagcauuaaucuccuuaacguguucaaauacaauuuucacguugacuguugcuuggagaacagccacccugauuuuggccggaguuucacuuuuaccagugugccagucuucgagcaugagaaaaacagacuggcuuccaaugacaguggcagcuaugggagucccaccccuaccacucuuuauuuuuagcuugaaagacacacucaaaaggagaagcuggccacugaaugaaggggugauggcuguuggacuugugagcauucuggccaguucucuccuuagaaaugacgugcccauggcuggaccauuaguggccgggggcuugcugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauaccagcgacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagacggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaauccaaagaacuuccaaaccaugccaggcacauuccagacuacaacaggggaaauaggagcaauugcauuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaucuuccagccauuguuagagaggcaaucaagagacguuuaagaacucugauuuuggcaccgacaagggugguugcagcugagauggaagaagcauugaaggggcucccaauaagguaccaaacaacagcaacaaaaucugaacauacgggaagagagauuguugaucuaaugugccacgcaacguucacaaugcgcuugcugucaccaguuaggguuccaaauuacaacuugauaauaauggaugaggcccauuucacagacccagccaguauagcggccagaggguacauaucaacucguguuggaaugggagaggcagccgcaaucuucaugacggcaacgcccccuggaacagcugaugccuuuccucagagcaacgcuccaauucaagaugaagaaagggacauaccagagcgcucauggaacucaggcaaugaauggaucaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugacugggacuuuguggugacaacugacauuucagaaaugggggccaauuucaaagcagauagagugaucgacccaagaagaugucuaaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaacacuccagaaggaaucauaccagcucucuuugaaccagaaagggagaagucagccgccauagacggugaauaucgccugaagggugaauccaggaagacuuucguggaacucaugaggaggggugaccucccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucguaauaggcauacuuacaauggcugcaauaauagcggccaaugaaaugggacuauuggaaacuacaaagagagaucuaggaaugucuaaggaaccagguguuguuucuccaacuagcuauuuggauguggauuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagacccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugcuuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagggguagugcaaaacuucaaugguuuguggaaaggaacauggucauucccgagggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaauuaaugaguggaaaggauguguuuuaucuuccgccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacugcaaaggaaacacggaggaaugcuugugagaaauccacuuucacgaaacuccacgcacgaaauguacuggauaucuaaugguacagguaacauugucucuucaguuaacaugguauccagauuguuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaacggagucgugaaacuucucacuaaaccaugggauguagugcccauggugacacagauggcaaugacagauacaacuccauuuggccagcagagagucuuuaaagagaagguggacaccaggacacccaggccuaugccagggacaagaaagguuauggagaucacagcggaguggcucuggagaacccugggaaggaacaaaagacccagguuaugcacaagggaagaguucacaaaaaaggucagaaccaacgcagccaugggcgccguuuucacagaggagaaccaaugggacagugcgaaagccgcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacauuauaucuaggaaagaccaaagaggcaguggacaggugggaacuuauggucugaacacauuuacuaacauggaagcccaguuagucagacaaauggaaggagaaggugugcugucaaagacagaccucgagaacccucaucugccagaaaagaaaauuacacaauggcuggaaaccaaaggaguggagagguuaaaaagaauggccauuagcggggaugauugcguagugaaaccaaucgaugacagguucgcuaacgcccugcuugcccugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaauuacaaccugggaaaauguuccauaccuagggaagagggaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7223 - RNA, 9873 nt, Artificial Sequence
  derived and/or modified CDS sequence (wt) from DENV-3__KX380842__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagaaaugugugaugacacggucacuuacaaaugcccccacauuaccgaaguggaaccugaagacauugacugcuggugcaaccuuacaucaacaugggugacuuauggaacguguaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcauccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagaugucccacccaaggggaagcgguuuugccugaggagcaggaccagaacuacguguguaagcacacauacguagauagaggcugggggaacggcugugguuuguuuggcaagggaagcuugguaacaugugcgaaauuucaaugccuggaaccgauagagggaaaaguagugcaauaugagaaccucaaauacaccgucaucauuacagugcacacaggagaccaacaccaggugggaaaugaaacgcagggaaucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagccacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaacauugaggcugaaccuccuuuuggggaaaguaauauaguaauuggaauuggagacaaugccuugaaaaucaauugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuuaacuuggauaggguugaauucaaaaaacacauccaugucauuuucaugcauugcaauaggaaucaucacacucuauuugggagcugugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauuguaggugcuugggaaaauggaguguguggaauuaggucaacaaccagaauggagaaucucuuguggaagcaaauagccaaugaacugaacuacauauuaugggaaaacaacaucaaauuaacgguaguugugggcgacacaaucgggguuuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuacuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaauugugggacaagaggcccaucauugagaacgacaacagugucaggaaaguugauacaugaaugguguugccgcucgugcacacuuccuccccugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggagucggacuggcuauggcaacaacguuacaauugccagaggacauugaacaaauggcaaauggaaucgcccuggggcucauggcucuuaaauugauaacacaauuugaaacauaccaauuauggacagcauuaaucuccuuaacguguucaaauacaauuuucacguugacuguugcuuggagaacagccacccugauuuuggccggaguuucacuuuuaccagugugccagucuucgagcaugagaaaaacagacuggcuuccaaugacaguggcagcuaugggagucccaccccuaccacucuuuauuuuuagcuugaaagacacacucaaaaggagaagcuggccacugaaugagggggugauggcuguuggacuugugagcaugcuggccaguucucuccuuagaaaugacgugcccauggcuggaccauuaguggccgggggcuugcugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauaccagcgacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagacggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaauccaaagaacuuccaaaccaugccaggcacauuccagacuacaacaggggaaauaggagcaauugcauuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaucuuccagccauuguuagagaggcaaucaagagacguuuaagaacucugauucuggcaccgacaagggugguugcagcugagauggaagaagcauugaaggggcucccaauaagguaccaaacaacagcaacaaaaucugaacauacgggaagagagauuguugaucuaaugugccacgcaacguucacaaugcgcuugcugucaccaguuaggguuccaaauuacaacuugauaauaauggaugaggcccauuucacagacccagccaguauagcggccagaggguacauaucaacucguguuggaaugggagaggcagccgcaaucuucaugacggcaacgcccccuggaacagcugaugccuuuccucagagcaacgcuccaauucaagaugaagaaagggacauaccagaacgcucauggaauucaggcaaugaauggaucaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugacugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugacgaagaccaugcucacuggacagaagcaaaaaugcugcuggacaacaucaacacuccagaaggaaucauaccagcucucuuugaaccagaaagggagaagucagccgccauagacggugaauaucgccugaagggugaauccaggaagacuuucguggaacucaugaggaggggugaccucccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcaggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucguaauaggcauacuuacaauggcugcaauaauagcggccaaugaaaugggacuauuggaaacuacaaagagagaucuaggaaugucuaaggaaccagguguuguuucuccaacuagcuauuuggauguggauuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagacccuguaauauaugauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuucuauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccguguccagggguagugcaaaacuucaaugguuuguggaaaggaacauggucauucccgagggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaauuaaugaguggaaaggauguguuuuaucuuccgccugaaaagugugacacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccagccgugauugagcaccuagaaagacugcaaaggaaacacggaggaaugcuugugagaaauccacuuucacgaaacuccacgcacgaaauguacuggauaucuaaugguacagguaacauugucucuucaguuaacaugguauccagauuguuacugaacagguucacgaugacacacaggagaccuaccauagagaaagauguggauuuaggagcaggaacucgacaugucaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucagccuccuccaugauaaacggagucgugaaacuucucacuaaaccaugggauguagugcccauggugacacagauggcaaugacagauacaacuccauuuggccagcagagagucuuuaaagagaagguggacaccaggacacccaggccuaugccagggacaagaaagguuauggagaucacagcggaguggcucuggagaacccugggaaggaacaaaagacccagguuaugcacaagggaagaguucacaaaaaaggucagaaccaacgcagccaugggcgccguuuucacagaggagaaccaaugggacagugcgaaagccgcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacaacaaauggacccugaacacaggcuguuagcgaacgcuauauuuaagcucacauaccaaaacaaaguggucaaaguucaacgaccgacuccaacgggcacgguaauggacauuauaucuaggaaagaccaaagaggcaguggacaggugggaacuuauggucugaacacauuuacuaacauggaagcccaguuagucagacaaauggaaggagaaggugugcugucaaagacagaccucgagaacccucaucugccagaaaagaaaauuacacaauggcuggaaaccaaaggaguggagagguuaaaaagaauggccauuagcggggaugauugcguagugaaaccaaucgaugacagguucgcuaacgcacugcuugcccugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaauaccaguccacuggguccccacaaguagaacgacauggucuauucaugcucaccaucaguggaugaccacagaagacaugcuuacuguuuggaacaggguguggaucgaggacaauccauggauggaagacaaaacuccaauuacaaccugggaaaauguuccauaccuagggaagagggaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7224 - RNA, 9873 nt, Artificial Sequence
  derived and/or modified CDS sequence (wt) from DENV-3__KX380839__SS-prME
acaucgcucugucucaugaugauguuaccagcaacacuugcuuuccacuugacuucacgagauggagagccgcgcaugauuguggggaagaaugaaagaggaaaaucccuacuauuuaagacagccucuggaaucaacaugugcacacucauagccauggauuugggagaaaugugugaugacacgaucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccagaccuggaugucggcugaaggagcuuggagacaagucgagaagguagagacaugggccuuuaggcacccaggguucacaauacuagcucuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugaccaccauggcuaagaacaagcccacgcuggacauagagcuccagaagaccgaggccacccaacuggcaacccuaaggaaacuauguauugagggaaaaaucaccaaugugacaaccgacucaaggugccccacucaaggggaagcgacucuaccugaggagcaggaccagaacuacguguguaagcacacauacguggacagaggcuggggaaaugguugugguuuguuuggcaagggaagcuugguaacaugcgcaaaauuccaauguuuggaauuaacagagggaaaaguggugcagcacgagaaccucaaauacaccgucaucaucacagugcacacaggagaccaacaccaggugggaaaugaaacgcagggagucacggcugagauaacaccccaggcuucaaccgucgaagccaucuuccgaucuuauggaacccuugggcuagaaugcucaccacggacagguuuggauuucaaugaaaugauuuugcugacaaugaagaacaaagcauggaugguacauagacaaugguuuuuugaccuaccucuaccauggacaucaggggcuacaacagaaacaccaaccuggaacaagaaagagcuucuugugacauucaaaaacgcacacgcaaaaaaacaagaaguaguuguccuuggaucgcaagagggagcaaugcauacagcacugacaggagcuacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggaaccugucaauauugaggcagaaccuccuuuuggggaaagcaacauaauaauuggaauuggagacaaagccuugaaaaucaauugguacaagaagggaagcucgauugggaagauguucgaggccacugccagaggggcaaggcgcauggcuaucuugggagacacagccugggacuuuggaucaguagguggugucuuaaauucacuagggaaaauggugcaccagauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucuaggagccguggugcaagcugacauggggugugucauaaacuggaaaggcaaagaacucaaauguggaaguggaauuuucguuaccaaugaaguccacaccuggacagagcaauacaaauuucaagcagacucccccaaaagacuggcgacagccauugcaggcgccugggagaauggagugugcggaaucaggucgacaaccagaauggagaaccucuuguggaagcaaauagcuaaugaacuaaacuacauauuaugggaaaacaacaucaaauuaacgguaguugugggugauauaauugggaucuuagagcaagggaaaagaacacuaacaccacaacccauggagcuaaaauauucauggaaaacauggggaaaggcgaaaauagugacagcugaaacacaaaauuccucuuuuauaauagaugggccaaacacaccggagugcccaaaugccucaagagcauggaaugugugggaaguggaagauuacggcuucggagucuucacaaccaauauauggcugaaacuccgagaaauguacacccaacuaugugaccacaggcuaaugucggcagccguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuggagagugauaugaucaucccaaagagucuggcugguccuaucucgcaacacaauuacaggccuggauaccacacccaaacggcaggaccauggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaauaugguaaaaucuuuagucucagcagggaguggaaagguggauaacuucacaaugggugucuugugucuugcaauccucuuugaagagguaaugagaggaaaauucgggaaaaagcacaugauugcagggguucuuuucacauuugugcuccuucucucagggcaaauaacauggagagacauggcgcgcacacucauaaugauuggauccaacgccucugacagaaugggaaugggcgucacuuaccuagcauugauugcaacauuuaaaauccagccauuuuuggcuuugggauucuuucugaggaaacugacaucuagagaaaauuuauuauuaggaguuggguuagccauggcaacaacguugcaacugccagaggacauugaacaaauggcgaauggaauagccuuggggcucauggcucucaaauugauaacacaauuugaaacauaccaacuaugggcggcauuagucucccuaauguguucaaacacaauuuucacguugacuguugccuggagaacagccacccugaucuuggccggaauuucgcuuuugccaaugugccaguccucgagcaugaggaaaacagauuggcucccaaugacuguggcagcuaugggaguuccaccucuaccacuuuuuauuuucaguuugaaagacacacucaaaaggagaagcuggccacugaaugagggggugauggccguuggacuugugagcauucuagcaagcucucuccuuaggaaugacguacccauggcuggaccauuaguggcugggggccugcugauagcaugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcucuugaaaacagcauuacuaauagugucaggcauuuuuccauacuccauaccugcaacacuucuggucuggcacacuuggcaaaagcaaacccaaagauccggcguccugugggacguacccagccccccagagacacagaaagcagaacuggaagaggggguuuauaggaucaagcagcaaggaauuuuuggaaagacccaagugggaguuggaguacaaaaagaaggaguuuuccacaccauguggcaugucacaagaggagcaguguugacacacaauggaaaaagacuggaaccaaacugggcuagcgugaaaaaagaucugauuucauacggaggaggauggagacugagugcacaauggcaaaaaggagaagaggugcagguuauugccguagagccugggaagaacccaaaaaacuuucaaaccaugccaggcauuuuccagacaacaacaggggagauaggagcgauugcacuggacuucaagccuggaaccucaggaucucccaucauaaacagagagggaaagguagugggacuauauggcaacggagugguuacaaagaaugguggcuaugucaguggaauagcucaaacaaacgcagaaccagacggaccgacaccagagcuggaagaagagauguucaaaaagcgaaaucuaaccauaauggaucuccauccugggucaggaaagacgcggaaauaccuuccagcuauaguuagagaggcaaucaagagacgcuuaaggacucuaauuuuagcaccaacaagggugguugcagcugagauggaagaagcauugaaggggcucccaauaagguaucaaacaacugcaacaaaaucugaacacacagggaaagagauuguugaccuaaugugucacgcaacguucacaaugcguuuacugucaccagucagaguuccaaacuacaacuugauaauaauggaugaggcucauuucacagauccagcuaguauagcggcuagaggguacauaucaacucguguaggaaugggagaggcagccgcaauuuucaugacagccacaccuccuggaacagcugaagccuuuccucagagcaacgcuccaauucaagaugaagaaagagacauaccagaacgcucauggaauucaggcaaugauuggauuaccgacuuugccggaaagacugugugguuuguccccagcaucaaagcugggaaugacauagcaaacugcuugcggaaaaauggaaaaaaggucauucaacuuaguaggaaaacuuuugacacagaauaucaaaagaccaaacuaaaugauugggacuuuguggugacaacagacauuucagaaaugggagccaauuucaaagcagacagagugaucgacccaagaagaugucucaaaccagucaucuugacagacggacccgagcgcgugauccuggcgggaccaaugccagucaccguggcgagugcugcgcaaaggagagggagaguuggcaggaacccacaaaaagaaaaugaccaauacauauucacgggccagccucucaacaaugaugaagaccacgcucacuggacggaagcaaaaaugcugcuagacaacaucaacacaccagaaggaaucauaccagcucucuuugaaccagaaagggagaagucagccgccauagacggcgaauaccgccugaaaggugaguccaggaagaccuuuguggaacucaugaggaggggugaucucccaguuuggcuagcucauaaaguagcaucagaagggaucaaauacacagacagaaaaugguguuuugauggagagcgcaacaaucaaauuuuagaggagaacauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuccacauuuagcucacagaacgagaaacgcucuggacaaucuggugauguugcacacgucagaauacggugggagggccuacaggcaugcaguggaggaauuaccagaaacaauggaaacacucuuacuccugggacucaugauccuguuaacagguggggugaugcuuuucuugauaucaggcaaagggguuggaaagacuucaauaggacucauuuguguaguugcuuccaguggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccagguguuguuucgccaaccagcuauuuggauguggaucugcacccagcaucagccuggacauuguacgcuguggccacaacaguaauaacaccaauguugagacacaccauagagaauuccacagcaaaugugucccuggcagccauagccaaccaggcagugguccugaugggucuagacaaaggauggccgauaucgaaaauggacuuaggcgugccacuauuagcacuggguugcuauucacaagugaacccacugacucucacagcggcagugcuccugcuagucacgcacuacgcuauuauaggcccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucugacccuagccacaggaccaauaacaacacucugggaaggaucaccugggaaguucuggaacaccacgauagcuguuuccauggcaaacaucuuuagagggagcuauuuagcaggagcugggcuugcuuuuuccaucaugaaaucaguuggaacaggaaagagaggaacagggucacaaggugaaacuuugggagaaaaguggaaaaagaaauugaaucaauuaucccggaaagaguuugaccucuacaaaaaauccggaaucacugaaguggauagaacagaagccaaagaaggguuaaaaagaggagaaauaacacaccaugccguauccagaggcagcgcaaaacuucaaugguucguggagagaaacauggucauuccugaaggaagagucauagacuugggcuguggaagaggaggcuggucauauuauugugcaggguugaaaaaaguuacagaagugcgaggauacacaaaaggcggcccaggacaugaagaaccaguaccuaugucuacauauggauggaacauagucaagcugauuaguggaaaggauguguuuuaucuuccaccugaaaagugugacacccuacugugugacauuggagaaucaucaccaagcccaacaguggaggagagcagaaccauaagagucuugaaaaugguugaaccauggcuaaaaaauaaccaguuuugcauuaaaguauugaacccuuacaugccagcugugauugagcaccuagaaagacuacaaaggaaacauggaggaaugcuugugagaaauccacucucacgaaacuccacgcacgaaauguacuggauaucuaauggcacaggcaacaucgucucuucagucaacaugauauccagacugcuacugaacagauucacaaugacauauaggagacccaccauagagaaagauguggauuugggagcggggacccgacaugucaaugcggaaccagaaacacccaacauggaugucauuggggaaagaauaagaaggauuaaggaggagcauaguucaacauggcacuaugaugaugaaaauccuuauaaaacgugggcuuaccauggaucuuaugaagucaaggccacaggcucagccuccuccaugauaaauggagucgugaaacuccucacgaaaccaugggauguggugcccacggugacacagauggcaaugacggacacgaccccuuuuggccagcaaagaguuuuuaaagagaaaguggacaccaggacacccaaacccaugccaggaacaagaaagguuauggagaucacagcggaauggcuuuggagaaccuugggaaggaacaaaagacccagauuaugcacgagagaagaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcuguguuuauaacaugaugggcaagagagagaagaaacuuggagaguuuggcaaagcaaaaggcaguagagccauaugguacaugugguugggagccagguaccuugaguucgaggcacucggauuuuuaaaugaagaccauugguucucgcgugaaaacucuuacaguggaguagaaggggaaggacugcauaagcugggauauaucuugagagauauuuccaagauacccggaggagcuauguaugcugaugacacagcagggugggacacaagaauaacagaagaugaccugcacaaugaggaaaaaauuacacagcaaauggacccugaacacaggcaguuagcaaacgcuauauuuaagcucacuuaccaaaacaaaguggucaaaguucaacgaccaacuccaaaaggcacgguaauggacaucauaucuaggaaagaccaaagaggcaguggacaggugggaaccuauggucuaaauacauucaccaacauggaagcccaguugaucagacagauggaaggagaagguguguugucgaagacagaccucgagaacccucaucugcuagagaagaaaaucacacaaugguuggaaaccaaaggaguggagagguuaaaaagaauggccaucaguggagaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguuggugguccccugcagaccucaggacgaauuaauagggagagcaagaaucucucagggagcaggauggagccuuaaagaaacugcaugcuuagggaaagccuacgcccaaaugugggcucucauguauuuucacagaagagaucuuagacuagcauccaaugccauauguucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7225 - RNA, 9873 nt, Artificial Sequence
  derived and/or modified CDS sequence (wt) from DENV-3__KX380840__SS-prME
acaucgcucugucucaugaugauguuaccagcaacacuugcuuuccacuugacuucacgagauggagagccgcgcaugauuguggggaagaaugaaagaggaaaaucccuacuauuuaagacagccucuggaaucaacaugugcacacucauagccauggauuugggagaaaugugugaugacacgaucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccagaccuggaugucggcugaaggagcuuggagacaagucgagaagguagagacaugggccuuuaggcacccaggguucacaauacuagcucuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugaccaccauggcuaagaacaagcccacgcuggacauagagcuccagaagaccgaggccacccaacuggcaacccuaaggaaacuauguauugagggaaaaaucaccaaugugacaaccgacucaaggugccccacucaaggggaagcgacucuaccugaggagcaggaccagaacuacguguguaagcacacauacguggacagaggcuggggaaaugguugugguuuguuuggcaagggaagcuugguaacaugcgcaaaauuccaauguuuggaauuaacagagggaaaaguggugcagcacgagaaccucaaauacaccgucaucaucacagugcacacaggagaccaacaccaggugggaaaugaaacgcagggagucacggcugagauaacaccccaggcuucaaccgucgaagccaucuuccgaucuuauggaacccuugggcuagaaugcucaccacggacagguuuggauuucaaugaaaugauuuugcugacaaugaagaacaaagcauggaugguacauagacaaugguuuuuugaccuaccucuaccauggacaucaggggcuacaacagaaacaccaaccuggaacaagaaagagcuucuugugacauucaaaaacgcacacgcaaaaaaacaagaaguaguuguccuuggaucgcaagagggagcaaugcauacagcacugacaggagcuacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggaaccugucaauauugaggcagaaccuccuuuuggggaaagcaacauaauaauuggaauuggagacaaagccuugaaaaucaauugguacaagaagggaagcucgauugggaagauguucgaggccacugccagaggggcaaggcgcauggcuaucuugggagacacagccugggacuuuggaucaguagguggugucuuaaauucacuagggaaaauggugcaccagauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucuaggagccguggugcaagcugacauggggugugucauaaacuggaaaggcaaagaacucaaauguggaaguggaauuuucguuaccaaugaaguccacaccuggacagagcaauacaaauuucaagcagacucccccaaaagacuggcgacagccauugcaggcgccugggagaauggagugugcggaaucaggucgacaaccagaauggagaaccucuuguggaagcaaauagcuaaugaacuaaacuacauauuaugggaaaacaacaucaaauuaacgguaguugugggugauauaauugggaucuuagagcaagggaaaagaacacuaacaccacaacccauggagcuaaaauauucauggaaaacauggggaaaggcgaaaauagugacagcugaaacacaaaauuccucuuuuauaauagaugggccaaacacaccggagugcccaaaugccuuaagagcauggaaugugugggaaguggaagauuacggcuucggagucuucacaaccaauauauggcugaaacuccgagaaauguacacccaacuaugugaccacaggcuaaugucggcagccguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuggagagugauaugaucaucccaaagagucuggcugguccuaucucgcaacacaauuacaggccuggauaccacacccaaacggcaggaccauggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaauaugguaaaaucuuuagucucagcagggaguggaaagguggauaacuucacaaugggugucuugugucuugcaauccucuuugaagagguaaugagaggaaaauucgggaaaaagcacaugauugcagggguucuuuucacauuugugcuccuucucucagggcaaauaacauggagagacauggcgcgcacacucauaaugauuggauccaacgccucugacagaaugggaaugggcgucacuuaccuagcauugauugcaacauuuaaaauccagccauuuuuggcuuugggauucuuucugaggaaacugacaucuagagaaaauuuauuauuaggaguuggguuagccauggcaacaacguugcaacugccagaggacauugaacaaauggcgaauggaauagccuuggggcucauggcucucaaauugauaacacaauuugaaacauaccaacuaugggcggcauuagucucccuaauguguucaaacacaauuuucacguugacuguugccuggagaacagccacccugaucuuggccggaauuucgcuuuugccaaugugccaguccucgagcaugaggaaaacagauuggcucccaaugacuguggcagcuaugggaguuccaccucuaccacuuuuuauuuucaguuugaaagacacacucaaaaggagaagcuggccacugaaugagggggugauggccguuggacuugugagcauucuagcaagcucucuccuuaggaaugacguacccauggcuggaccauuaguggcugggggccugcugauagcaugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcucuugaaaacagcauuacuaauagugucaggcauuuuuccauacuccauaccugcaacacuucuggucuggcacacuuggcaaaagcaaacccaaagauccggcguccugugggacguacccagccccccagagacacagaaagcagaacuggaagaggggguuuauaggaucaagcagcaaggaauuuuuggaaagacccaagugggaguuggaguacaaaaagaaggaguuuuccacaccauguggcaugucacaagaggagcaguguugacacacaauggaaaaagacuggaaccaaacugggcuagcgugaaaaaagaucugauuucauacggaggaggauggagacugagugcacaauggcaaaaaggagaagaggugcagguuauugccguagagccugggaagaacccaaaaaacuuucaaaccaugccaggcauuuuccagacaacaacaggggagauaggagcgauugcacuggacuucaagccuggaaccucaggaucucccaucauaaacagagagggaaagguagugggacuauauggcaacggagugguuacaaagaaugguggcuaugucaguggaauagcucaaacaaacgcagaaccagacggaccgacaccagagcuggaagaagagauguucaaaaagcgaaaucuaaccauaauggaucuccauccugggucaggaaagacgcggaaauaccuuccagcuauaguuagagaggcaaucaagagacgcuuaaggacucuaauuuuagcaccaacaagggugguugcagcugagauggaagaagcauugaaggggcucccaauaagguaucaaacaacugcaacaaaaucugaacacacagggaaagagauuguugaccuaaugugucacgcaacguucacaaugcguuuacugucaccagucagaguuccaaacuacaacuugauaauaauggaugaggcucauuucacagauccagcuaguauagcggcuagaggguacauaucaacucguguaggaaugggagaggcagccgcaauuuucaugacagccacaccuccuggaacagcugaagccuuuccucagagcaacgcuccaauucaagaugaagaaagagacauaccagaacgcucauggaauucaggcaaugauuggauuaccgacuuugccggaaagacugugugguuuguccccagcaucaaagcugggaaugacauagcaaacugcuugcggaaaaauggaaaaaaggucauucaacuuaguaggaaaacuuuugacacagaauaucaaaagaccaaacuaaaugauugggacuuuguggugacaacagacauuucagaaaugggagccaauuucaaagcagacagagugaucgacccaagaagaugucucaaaccagucaucuugacagacggacccgagcgcgugauccuggcgggaccaaugccagucaccguggcgagugcugcgcaaaggagagggagaguuggcaggaacccacaaaaagaaaaugaccaauacauauucacgggccagccucucaacaaugaugaagaccacgcucacuggacggaagcaaaaaugcugcuagacaacaucaacacaccagaaggaaucauaccagcucucuuugaaccagaaagggagaagucagccgccauagacggcgaauaccgccugaaaggugaguccaggaagaccuuuguagaacucaugaggaggggugaucucccaguuuggcuagcucauaaaguagcaucagaagggaucaaauacacagacagaaaaugguguuuugauggagagcgcaacaaucaaauuuuagaggagaacauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuccacauuuagcucacagaacgagaaacgcucuggacaaucuggugauguugcacacgucagaauacggugggagggccuacaggcaugcaguggaggaauuaccagaaacaauggaaacacucuuacuccugggacucaugauccuguuaacagguggggugaugcuuuucuugauaucaggcaaagggguuggaaagacuucaauaggacucauuuguguaguugcuuccaguggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccagguguuguuucgccaaccagcuauuuggauguggaucugcacccagcaucagccuggacauuguacgcuguggccacaacaguaauaacaccaauguugagacacaccauagagaauuccacagcaaaugugucccuggcagccauagccaaccaggcagugguccugaugggucuagacaaaggauggccgauaucgaaaauggacuuaggcgugccacuauuagcacuggguugcuauucacaagugaacccacugacucucacagcggcagugcuccugcuagucacgcacuacgcuauuauaggcccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucugacccuagccacaggaccaauaacaacacucugggaaggaucaccugggaaguucuggaacaccacgauagcuguuuccauggcaaacaucuuuagagggagcuauuuagcaggagcugggcuugcuuuuuccaucaugaaaucaguuggaacaggaaagagaggaacagggucacaaggugaaacuuugggagaaaaguggaaaaagaaauugaaucaauuaucccggaaagaguuugaccucuacaaaaaauccggaaucacugaaguggauagaacagaagccaaagaaggguuaaaaagaggagaaauaacacaccaugccguauccagaggcagcgcaaaacuucaaugguucguggagagaaacauggucauuccugaaggaagagucauagacuugggcuguggaagaggaggcuggucauauuauugugcaggguugaaaaaaguuacagaagugcgaggauacacaaaaggcggcccaggacaugaagaaccaguaccuaugucuacauauggauggaacauagucaagcugauuaguggaaaggauguguuuuaucuuccaccugaaaagugugacacccuacugugugacauuggagaaucaucaccaagcccaacaguggaggagagcagaaccauaagagucuugaaaaugguugaaccauggcuaaaaaauaaccaguuuugcauuaaaguauugaacccuuacaugccagcugugauugagcaccuagaaagacuacaaaggaaacauggaggaaugcuugugagaaauccacucucacgaaacuccacgcacgaaauguacuggauaucuaauggcacaggcaacaucgucucuucagucaacaugauauccagacugcuacugaacagauucacaaugacauauaggagacccaccauagagaaagauguggauuugggagcggggacccgacaugucaaugcggaaccagaaacacccaacauggaugucauuggggaaagaauaagaaggauuaaggaggagcauaguucaacauggcacuaugaugaugaaaauccuuauaaaacgugggcuuaccauggaucuuaugaagucaaggccacaggcucagccuccuccaugauaaauggagucgugaaacuccucacgaaaccaugggauguggugcccacggugacacagauggcaaugacggacacgaccccuuuuggccagcaaagaguuuuuaaagagaaaguggacaccaggacacccaaacccaugccaggaacaagaaagguuauggagaucacagcggaauggcuuuggagaaccuugggaaggaacaaaagacccagauuaugcacgagagaagaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcuguguuuauaacaugaugggcaagagagagaagaaacuuggagaguuuggcaaagcaaaaggcaguagagccauaugguacaugugguugggagccagguaccuugaguucgaggcacucggauuuuuaaaugaagaccauugguucucgcgugaaaacucuuacaguggaguagaaggggaaggacugcauaagcugggauauaucuugagagauauuuccaagauacccggaggagcuauguaugcugaugacacagcagggugggacacaagaauaacagaagaugaccugcacaaugaggaaaaaauuacacagcaaauggacccugaacacaggcaguuagcaaacgcuauauuuaagcucacuuaccaaaacaaaguggucaaaguucaacgaccaacuccaaaaggcacgguaauggacaucauaucuaggaaagaccaaagaggcaguggacaggugggaaccuauggucuaaauacauucaccaacauggaagcccaguugaucagacagauggaaggagaagguguguugucgaagacagaccucgagaacccucaucugcuagagaagaaaaucacacaaugguuggaaaccaaaggaguggagagguuaaaaagaauggccaucaguggagaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguuggugguccccugcagaccucaggacgaauuaauagggagagcaagaaucucucagggagcaggauggagccuuaaagaaacugcaugcuuagggaaagccuacgcccaaaugugggcucucauguauuuucacagaagagaucuuagacuagcauccaaugccauauguucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7226 - RNA, 9873 nt, Artificial Sequence
  derived and/or modified CDS sequence (wt) from DENV-3__JF808121__SS-prME
acaucgcucugccucaugaugauauugccagcagcacuugcuuuccacuugacuucacgagauggagagccgcgcaugauuguggggaagaaugaaagaggaaaaucccuacuuuuuaagacagccucuggaaccaacaugugcacacucauagccauggacuugggagagaugugugaugacacggucacuuacaaaugcccccacauuaccgaaguggaaccugaagacauugacuguuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccaaaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaacuaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuuucggggcauuuaaaauguagacucaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuagguaaaauggugcaccaaauauucggaagugcuuacacagcccuauucaguggagucucuuggguaaugaaaaucggaauaggaguucucuugacuuggauaggguugaauucaaaaaacacauccaugucauuuucauguauugcgauaggaaucauuacacucuaucuaggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuuuacguuugugcuccuucucucagggcaaauaacauggagagacauggcgcacacacuaacaaugauuggguccaacgcaucugacaggaugggaaugggcguuaccuaccuagccuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggauagcauuaaucuccuuaacguguucaaacacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuaucuuuagcuugaaagacacacucaaaaggagaagcuggccacugaaugaaggggugauggcuguugggcuugugagcauuuuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggagucuuuccauacuccauaccugcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacgggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagagcgcucauggaauucaggcaaugaauggauaacugacuucgcugggaaaacggugugguuuguccccagcauuaaagccggaaaugacauagcaaacugcuugcggaaaaacgggaaaaaggucauccaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuacuggacaacauuaauacaccagaagggaucauaccagcucucuuugagccagaaagggagaagucagcugccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcucuucuuaauaucagguaaagggauuggaaagacuucaauaggacucauuuguguaauugcuuccaguggcauguuguggauggccgaaaucccacuccaauggaucgcgucggcuauaguccuggaguuuuucaugaugguguugcuuauaccagaaccagaaaagcagagaaccccccaagacaaccaacucgcauaugucgugauaggcauacuuacauuggcugcaauaauagcagcuaacgaaaugggauuguuggaaacuacaaaaagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcugcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaucuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugaaacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggaaaacccugggaaggaacaaaaaacccagguuaugcccaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugccagagaagaaaauuacacaaugguuggaaaccaaaggaguggagagguuaaaaaggauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggaucgggauggagccuuagagaaaccgcaugucuggggaaagccuacgcucaaauguggagucucauguauuuucacagaagagaccucagacuagcauccaacgccauauguucagcuguaccaguccacuggguccccacaaguagaaugacauggucuauucaugcucaccaucaguggaugaccacagaagacaugcuuacugucuggaauaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7227 - RNA, 9873 nt, Artificial Sequence
  derived and/or modified CDS sequence (wt) from DENV-3__JF808120__SS-prME
acaucgcucugccucaugaugauauugccagcagcacuugcuuuccacuugacuucacgagauggagagccgcgcaugauuguggggaagaaugaaagagggaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagccuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggagugggaaacagagauuuuguggaaggucuaucaggagcuacguggguugacguggugcucgagcacggggggugugugacuaccauggcuaagaacaagccaacguuggauauagagcuucagaagacugaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaacuaauagagggaaaaguggugcaguaugagaaccucaaauacaccgucaucaucacugugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaagggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuagguaaaauggugcaccaaauauuuggaagugcuuacacagcccuauucaguggagucucuuggguaaugaaaaucggaauaggaguucucuugacuuggauaggguugaauucaaaaaacacauccaugucauuuucaugcauugcgauaggaaucaucacacucuaucuaggagccguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuaaagcaaggaaaaagaacacuaacaccacaacccauggagcugaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuuuacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuuuacguuugugcuccuucucucagggcaaauaacauggagagacauggcgcacacacuaauaaugauuggguccaacgcaucugacaggaugggaaugggcguuaccuaccuagccuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuaucuuuaacuugaaagacacacucaaaaggagaagcuggccacugaaugaaggggugauggcuguugggcuugugagcauuuuggccaguucucuccuuagaaaugauguacccauggcuggaccauugguggccgggggcuugcuaauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauucuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcagaagggggaggaggugcagguuauugccguagagccugggaagaacccaaagaacuuucaaaccaugccaggcacuuuucagacuacaacgggggaaauaggagcaauugcacuggauuucaagccuggaacuucaggaucucccaucauaaauagagagggaaagguagugggacuguauggcaauggagugguuacaaagaaugguggcuacgucagcggaauagcgcaaacgaaugcagaaccagauggaccgacaccagaacuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuauugaccuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagagcgcucauggaauucaggcaaugaauggauaaccgacuucgcugggaaaacggugugguuuguccccagcauuaaagccggaaaugacauagcaaacugcuugcgaaaaaacggaaaaaaggucauccaacuuagcaggaagacuuuugacacagaauaucagaaaaccaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucacugcggcgagugcugcgcaaaggagagggagaguuggcaggaacccacaaaaagaaaaugaccaguacauauucacgggccagccucucaauaaugaugaagaccaugcucacuggacagaagcaaaaaugcugcuggacaacauuaauacaccagaagggaucauaccagcucucuuugagccagaaagggagaagucagcugccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacaucagaacauggcgguagggccuacaggcaugcgguggaggaacuaccagagacaauggaaacacuccuacucuugggacucaugaucuuguugacagguggagcaaugcucuucuuaauaucagguaaagggauuggaaagacuucaauaggacucauuugcguaauugcuuccaguggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaacgaaaugggauuguuggaaacuacaaaaagagauuuaggaaugucuaaggagccaggcguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcaguaguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacaguggaugggauaaugacaauagaccuagaucccguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaauaacacaucaugccguguccagagguagcgcaaaacuucaaugguucguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuaugaccacauauggauggaacauaguuaaguuaaugaguggaaaggauguguuuuaucuuccaccugaaaagugugacacccuguugugugacauuggagaaucuucaccaagcccaacgguggaagaaagcagaacuauaagagucuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagccgcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguuaggagccagguaccuugaguucgaagcccuuggauucuuaaaugaagaccacugguucucgcgugagaacucuuacaguggaguggaaggagaaggacugcacaagcuaggcuauauacuaagggacauuuccaagauacccggaggagcuauguaugcagaugacacagcugguugggacacaagaauaacagaagaugaccugcacaaugaggaaaagaucacacagcaaauggacccugaacacaggcaguuagcgaacgcuauuuuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggaucgggauggagccuuagagaaaccgcaugucuggggaaagccuacgcucaaauguggagucucauguauuuucacagaagagaccucagacuagcauccaacgccauauguucagcuguaccaguccacuggguccccacaaguagaacgacauggucuauucaugcucaccaucaguggaugaccacagaagacaugcucacugucuggaauaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7228 - RNA, 9873 nt, Artificial Sequence
  derived and/or modified CDS sequence (wt) from DENV-3__JF808119__SS-prME
acaucgcucugucucaugaugauauugccaacagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcucuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcccacaauggcagacugauuacagccaacccaguggugacuaagaaggacgagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccauuuugggagacacagccugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaaccacaacagugucagggaaguuaauacacgaaugguguugccguucguguacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucauguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugaggauaaaagaugaugagacugagaauauccuaacaguacuuuugaaaacagcauuacuaauagugucaggagucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaagcagcaaggaauuuuugggaaaacccaaguagggguuggaguacagaaagaaggagucuuccacaccauguggcacgucacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggagugccccuacuggcauuggguugcuauucacaagugaacccacugacucuaacagcggcaguacucuugcugaucacacauuaugcuauuauagguccaggauugcaggcaaaagccacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaacuaucccggaaagaguuugaccuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaauuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagagguuaaaaagaauggccauuagcggggaagauugcguauugaaaccaauugaugacagguucgauaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaagcagaacgacauggucuauucaugcucuccaucaguggaugaccacagaagacaugauuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7229 - RNA, 9873 nt, Artificial Sequence
  derived and/or modified CDS sequence (wt) from DENV-3__JF808118__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccucacaucaacaugggugacuuacggaacgugcaaucaagccggagagcguagacgcgacaagagaucaguggcguuagcuccccaugucggcaugggacuagacacacgcacucaaaccuggaugucggcugaaggagcuuggaggcaagucgagaagguagagacaugggcccuuaggcacccaggguucaccauacuagcccuauuucuugcucauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgauccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauacugcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguagugcaagcugacaugggauguguuauaaacuggaaaggcaaagaacucaaauguggaaguggaaucuucgucaccaacgagguccauaccuggacagagcaauacaaauuccaagcagacuccccgaaaagauuggcgacagccauugcaggcgcuugggagaauggagugugcggaauuaggucaacaaccagaauggagaaucuccuguggaagcaaauagccaaugaauugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccauuagugagaaagaagagaacaugguaaagucuuuagucucagcgggaaguggaaagguggacaacuucacaaugggugucuuguguuuggcaauucucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuagggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccacuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugagucuaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaagaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacuccugggacucaugaucuuguugacagguggagcaaugcuuuucuuaauaucugguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacggcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuggaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggucagcagagagucuuuaaagagaaaguggacaccaggacacccagguccaugccaggaacaagaagggucauggggaucacagcggaguggcucuggagaaccuugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccaucagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccucaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaacuugggaaaaugucccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7230 - RNA, 9873 nt, Artificial Sequence
  derived and/or modified CDS sequence (wt) from DENV-3__JF808127__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccaucccugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauacggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucacaagagggagcaaugcauaccgcauugacaggagccacagaaauccaaaacucaggaggcacaaguauuuuugcggggcauuuaaaauguagacuuaagauggacaaauuggaacuuaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggaaccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcugaaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggauaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcaguggucuugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuaacaagaaaucuggaaucacugaaguggauagaacagaagccaaagaaggguugaaaagaggagaaauaacacaucaugccguguccagagguagcgcaaaacuucaaugguuuguggagagaaacauggucauucccgaagggagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaaaaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccaaguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7231 - RNA, 9873 nt, Artificial Sequence
  derived and/or modified CDS sequence (wt) from DENV-3__JF808124__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacagucacuuacaaaugcccccacauuacugaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaaccuuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcccacaauggcagacugauuacagccaacccaguggugacuaagaaggaggagcuugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaauuauuacacucuaccugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaaugggaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggccuggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucguguacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguuguucacgugugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaaugggaaauggaaucgcucuggggcucauggcucuuaaacugauaacacaauuugaaacauaccaauuauggacagcauugaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugacggaacaaugagaauaaaagaugaugagacugagaauauccuaacagugcuuuugaaaacagcauuacuaauacuaucaggagucuuuccauacuccauacccgcaacguugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauaggggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaaugggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucauauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcaugucguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucuccccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaagccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcucuuggauucuuaaaugaagaccacugguucucacgugagaacucuuacaguggaguggaaggagaaggacugcacaagcuaggcuauauauuaagggacaucuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaaugauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccuuagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7232 - RNA, 9873 nt, Artificial Sequence
  derived and/or modified CDS sequence (wt) from DENV-3__JF808126__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaagugcccccacaucaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuacacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuucuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauuuggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaagucaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacagcgggacccuggcauuuaggaaaauuagagcuggacuucaacuauugugaaggaacaacaguugucaucacagaaaacugugggacaagaggcccagcauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcugcccacugaaugaaggggugauggcuguugggcuugugagcauucuagccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugguuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguccaaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacagugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauuuacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaagauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacucccauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaagaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7233 - RNA, 9873 nt, Artificial Sequence
  derived and/or modified CDS sequence (wt) from DENV-3__JF808125__SS-prME
acaucgcucugucucaugaugauauugccagcagcacuugcuuuccacuugacuucacgagauggagagccgcgcaugauugugggggagaaugaaagaggaaaaucccuacuuuuuaagacagccucuggaaucaacaggagaacgcucauagccauggacuugggagagaugugugaagaaacggaaacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacagcggaaacaccaaccuggaacaggaaggagcuucuugugacauuuaaaaacgcacaugcgaagaaacaagaaguagucguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugcuucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggaggacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucuuccggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggauaaucuggugaugcugcacacgucagaacauggcgguagggccuacaggcaugcgguggaggaacuaccagagacaauggaaacacuccuacucuugagacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcaguggucuugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaagggagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagauauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7234 - RNA, 9873 nt, Artificial Sequence
  derived and/or modified CDS sequence (wt) from DENV-3__JF808129__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaauaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaacuggggucuuagagcaaggaaaaagaacacuaacaccacaaccuauggagcugaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacugcacaaugggugucuuguguuuggcaauccucuuugaagacgugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaccacagucgaugaugauggaacaaugagaauaaaagaugaugagacugagaauauccuaacagugcuuuugaagacagcauuaacaauaguaucaggagucuuuccauacuccauacccgcaacauugcuggucuggcauacuuggcaaaagcaaacccaaagauccggcguucuaugggacguacccagccccccagagacacagaaagcagagcaggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaacuuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaaugggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuucgauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguucuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggacuaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7235 - RNA, 9873 nt, Artificial Sequence
  derived and/or modified CDS sequence (wt) from DENV-3__JF808123__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccacuuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccugggaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaaugguagacugauuacagccaacccaguggugaccaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaagugggaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacguuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugaccguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucggcagaccucaccguagaaaaagcagcagauauaacaugggaggaagaggcugagcaaacaggagugucccacaacuuaaugaucacaguugaugaugauggaacaaugagaauaaaagaugaugagaccgagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaccugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccagggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagaaauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuucgauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugccuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggaccuaggaguaccccuacuggcauuggguugcuauucacaagugaacccacugacucuaacagcggcaguacucuugcugaucacacauuacgcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugcgcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccagaaggaagagucauagacuugggcuguggaagaggaggcuggucauauuacugugcaggacugaaaaaagucacagaagugcgaggauacacaaaaggcgguccaggacacgaagaaccaguacccauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguag

SEQ ID NO: 7236 - RNA, 9873 nt, Artificial Sequence
  derived and/or modified CDS sequence (wt) from DENV-3__JF808128__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaagugcccccacaucaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaggaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcaaggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuucuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauuuggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuauauauugugggaaaacaauaucaaauuaacgguaguugugggcgauauaauuggggucuuagagcaaggaaaaagaacacuaacaccacaacccauggagcuaaaauacucauggaaaacguggggaaagucaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacagcgggacccuggcauuuaggaaaauuagagcuggacuucaacuauugugaaggaacaacaguugucaucacagaaaacugugggacaagaggcccagcauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuagccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugguuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacagugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauuuacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaagauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuucccgcagcaugucguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcggcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaagaugaggauuuuuggaaacuuguggacagagaacgugaacuccacaaacugggcaaguguggaagcugcguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7237 - RNA, 9873 nt, Artificial Sequence
  derived and/or modified CDS sequence (wt) from DENV-3__JF808122__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaucaagugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccccccacuuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaaugguagacugauuacagccaacccaguggugaccaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucuuuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaaggacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggauuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccaguggcaugucguggauggccgaaaucccacuccaauggaucgcgucggcuauagucuuggaguuuuuuaugaugguguugcuuauaccagaaccagaaaagcagagaaccccccaagacaaucaacucgcauaugucgugauaggcauacuuacauuggcugcaauaauagcagcuaaugaaaugggauuguuggaaacuacaaaaagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaacgugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauccccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaacggaaguagagcuauaugguacaugugguugggagccagguaccuugaguucgaagcccuuggauucuuaaaggaauaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguuugcuaaugcccugcucgcucugaacgauacgggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7238 - RNA, 9873 nt, Artificial Sequence
  derived and/or modified CDS sequence (wt) from DENV-3__GQ466079__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgagguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucaucacacucuaucugggagcuguggugcaagcugacauggggugugucauaaacuggaaaggcaaagaacuuaaaugcggaaguggaauuuucgucaccaacgagguccauaccuggacagagcaguacaaauuccaagcagacuccccaaaaagauuggcgacagccauugcaggcgcuugggagaauggagugugugggauuaggucaacaaccagaauggagaaccucuuguggaagcaaauagccaaugaacugaacuacauauuaugggaaaacaauaucaaacuaacaguaguugugggcgauacaauuggggucuuagagcaagggaagagaacacuaacaccacaacccauggagcuaaaauacucauggaaaacguggggaaaggcaaaaauagugacagcugaaacacaaaacuccuuuuuuauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuacuggauagaaagccaaaagaauggaaguuggaagcuagaaaaagcaucccucauagagguaaaaaccugcacauggccaaaaucacacacucucuggagcaacggugugcuagagagugacaugaucauuccaaagagucuagcuggucccauuucgcaacacaaccacaggcccggguaccacacccaaacggcaggacccuggcacuuagaaaauuuggagcuggacuucaccuauugugaaggaacaacaguugucaucacagaaaacugugggacaagaggcccaucauugagaacgacaacaguaucaggaaaguugauacacgaaugguguugccgcucgugcacacuuccuccucugcgauacaugggagaagacggcuguugguauggcauggaaaucagacccaucagugagaaagaagagaacaugguaaagucuuuagucucagcgggaaguggaaagguagacaacuucacaauggguaucuugugcuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuugauugcaacauuuaaaauccagccauuccuggcuuugggauuuuuccuaagaaaacugacaucuagagaaaauuuacuguuaggaguuggacuggcuauggcaacaacguuacaacugccagaggacauugaacaaauggcaaauggaaucgcccuggggcucauggcucuuaaauugauaacacaauuugaaacauaccaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuugccaguucucuccuuagaaaugacguacccauggcuggaccauuaguggccgggggcuugcugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguauuuuuccauacuccauacccgcaacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagcccgggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaauuauaacuugauaauaauggaugaggcccauuucacagacccagccaguauagcggccagaggguacauaucaacucguguuggaaugggagaggcagccgcaauuuucaugagugcaacgcccccuggaacagcugaugccuuuccucagagcaaugcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugaucuuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauugagaccuagguggcuugaugcccgcacuuauucagaucccuuagcacucaaggaauucaaggacuuugcggcuggcagaaagucaauugcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacuguuggaaacuacaaagagagauuuaggaaugucuaaggagcccgguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaauuacacauuaugcuauuauagguccaggacugcaggcaaaagccacucgugaagcucaaaaaaggacagcugcuggaauaaugaagaauccaacgguggaugggauaauaacgauagaccuagauccuguaauauacgauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccgugucuagagguagugcaaaacuucaaugguuaguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuguuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaagccacaggcucagccuccuccaugauaaauggagucgugaaacuucucacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggcgccguuuucacagaggagaaccaaugggacagugcgaaagcugcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggauccagguaccuugaguucgaagcccuuggauucuuaaaugaagaccacugguucucgcgugaaaacucuuacaguggaguagaaggagaaggacugcacaagcuaggcuacauauuaagggauaucuccaagauacccggaggagccauguaugcugaugacacagcugguugggacacaagaauaacagaagaugaccugcacaaugaggaaaagaucacacagcaaauggacccugaacacaggcuguuagcgaacgcuauauucaagcucacauaccaaaacaaaguggucaaaguucaacgaccgacuccaacgggcacgguaauggacaucauaucuaggaaagaccaaaggggcaguggacaggugggaacuuauggucugaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaauugaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7239 - RNA, 9873 nt, Artificial Sequence
  derived and/or modified CDS sequence (wt) from DENV-3__FJ898462__SS-prME
acaucgcucugucucaugaugauauugccagcagcacuugcuuuccacuugacuucacgagacggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcggucuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcccacaauggcagauugauuacagccaacccaguggugacuaagaaggaggagccugucaauauugaggcugaaccuccuuuuggggaaaguaauauagugauuggaauuggagacaacgccuuaaaaaucaacugguacaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaaccuauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaggggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguagaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaauaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacaguaauggacaucauaucuaggaaagaccaaagaggcaguggacagguaggaacuuauggacugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7240 - RNA, 9873 nt, Artificial Sequence
  derived and/or modified CDS sequence (wt) from DENV-3__KF955473__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgauccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauacugcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguagugcaagcugacaugggauguguuauaaacuggaaaggcaaagaacucaaauguggaaguggaaucuucgucaccaacgagguccauaccuggacagagcaauacaaauuccaagcagacuccccgaaaagauuggcgacagccauugcaggcgcuugggagaauggagugugcggaauuaggucaacaaccagaauggagaaucuccuguggaagcaaauagccaaugaauugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccauuagugagaaagaagagaacaugguaaagucuuuagucucagcgggaaguggaaagguggacaacuucacaaugggugucuuguguuuggcaauucucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuagggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccacuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugagucuaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaagaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacuccugggacucaugaucuuguugacagguggagcaaugcuuuucuuaauaucugguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacggcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggucagcagagagucuuuaaagagaaaguggacaccaggacacccagguccaugccaggaacaagaagggucauggggaucacagcggaguggcucuggagaaccuugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccucaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaacuugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7241 - RNA, 9873 nt, Artificial Sequence
  derived and/or modified CDS sequence (wt) from DENV-3__FJ850079__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagccacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaacuuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauguugaggcugaaccuccuuuuggggaaaguaauauaguaauuggaauuggagacaacgccuugaaaaucaacugguacaagaagggaagcuccauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauuuaguggagucucuuggguaaugaaaauuggaauaggaguucucuugacuuggauaggguugaauucaaaaaacacauccaugucauuuucaugcauugcaauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaacuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggaccuuggcauuuaggaaaauuagagcuggacuuuaacuauugcgaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccaaccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaaguuggccacugaaugaaggggugauggcuguugggcuugugagcauucuggccaguucucuucuuagaaaugauguacccauggcuggaccauuaguggccgggggcuugcugauagcgugcuacguuauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuuggaaaaacccaaguagggguuggaguacagaaagaaggagucuuucacaccauguggcacguuacaagaggggcaguauugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggagauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaauuuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaacaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccucaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccaguuauuuagauguggacuugcacccagcaucagccuggacauuguacgcuguggccaccacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagaccccguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagauuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacgcccaacauggaugucauuggggaaagaauaaaaaggaucaaggaggagcaugauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacgcagauggcaaugacagauacaacuccauuuggccagcagagagucuuuaaagagaaaguggacaccaggacgcccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauuuaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7242 - RNA, 9873 nt, Artificial Sequence
  derived and/or modified CDS sequence (wt) from DENV-3__FJ850080__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcucuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaagagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacacagcaugggacaauacucauuaaggucgaguacaaaggggaagaugcaccuugcaagauuccuuucuccacagaggauggacaagggaaagcccacaauggcagacugauuacagccaacccaguggugacuaagaaggacgagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccauuuugggagacacagccugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaauacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucguguacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucauguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaauagugucaggagucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaagcagcaaggaauuuuugggaaaacccaaguagggguuggaguacagaaagaaggagucuuccacaccauguggcacgucacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccuggaaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaacuaucccggaaagaguuugaccuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaauuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagagguuaaaaagaauggccauuagcggggaugauugcguagugaaaccaauugaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcccaaauguggagucucauguauuuucacagaagagaccucagacuagcauccaacgccauauguucagcaguaccaguccacuggguccccacaagcagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucagagggagccauuugguaa

SEQ ID NO: 7243 - RNA, 9873 nt, Artificial Sequence
  derived and/or modified CDS sequence (wt) from DENV-3__FJ850083__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagauacacgcacccaaaccuggaugucggcugaaggagcuuggaggcaagucgagaagguagagacaugggcccuuaggcauccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggagggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaacaugagaaccucaaauacaccgucaucaucacagugcacacaggagaucaacaccaggugggaaacgaaacgcagggagucacggcugagauaacaccucaggcaucaaccacugaagccaucuugccugaauauggaacucuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagagagaagucucagaaacgcagcaugggacaauacucauuaaggucgaguacaaaggggaagaugcaccuugcaagauuccuuucuccacagaggauggacaagggaaagcccacaauggcagacugauuacagccaacccaguggugacuaagaaggacgagccugucaauauugaggcugaaccuccuuuuggggaaaguaauauagugauuggaauuggagacaacgccuugaaaaucaacugguauaagaaaggaagcucuauugggaagauguucgaggccaccgccagaggugcaaggcgcauggccaucuugggagacacagccugggacuuuggaucagugggugguguucugaauucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaccauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuggagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaauagugucaggagucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaagcagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucgugguuacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcuacuggacaacauuaauacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacuuaaggaauucaaggacuuugcggcuggcagaaagucaauugcccuugaucuugugacagaaauaggaagaguaccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagcuacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcagggcuugcuuuuucuauuaugaaaucaguuggaacaggaaaaagaggaacaggcucacaaggugaaacuuuaggagaaaaauggaaaaagaaauuaaaucaacuaucccggaaagaguuugaccuuuacaagaaaucuggaaucacugaaguggauagaacagaagccaaagaaggguugaaaagaggagaaacaacacaucacgccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccagaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacucugggaaggaacaaaaaacccagguuaugcacaagggaagaguuuacaaaaaaggucagaacuaacgcagccaugggcgccguuuucacagaggagaaccaaugggacagcgcgaaagccgcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauaggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7244 - RNA, 9873 nt, Artificial Sequence
  derived and/or modified CDS sequence (wt) from DENV-3__FJ850086__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcucuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuuggguuagaaugcucaccacgggcagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacacagcaugggacaauacucauuaaggucgaguacaaaggggaagaugcaccuugcaagauuccuuucuccacagaggauggacaagggaaagcccacaauggcagacugauuacagccaacccaguggugacuaagaaggacgagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccauuuugggagacacagccugggacuuuggaucagugggugguguucugaacucauuaggcaaaacggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucguguacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucauguuugugcuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaauagugucaggagucuuuccauacuccauacccgcaacauugcuggucuggcauacuuggcaaaagcaaacccaaagauccggcguucuaugggacgugcccagucccccagagacacagaaagcagaacuggaagaaggggucuauaggaucaagcagcaaggaauuuuugggaaaacccaaguagggguuggaguacagaaagaaggagucuuccacaccauguggcacgucacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcugggcuugcuuucucuauuaugaaaucaguuggaacaggaaaaagaggaacaggcucacaaggugaaacuuuaggagaaaaauggaaaaagaaauuaaaucaacuaucccggaaagaguuugaccuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaauuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgccauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagagguuaaaaagaauggccauuagcggggaugauugcguagugaaaccaauugacgacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcucaaauguggagucucauguauuuucacagaagagaccucagacuagcauccaacgccauauguucagcaguaccaguccacuggguccccacaagcagaacgacauggucuauucaugcucaccaucaguggaugaccacagaagacaugcuuacugucuggaacaggguguggaucgaggacaauccauggauggaagacaaaacuccaguuacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7245 - RNA, 9873 nt, Artificial Sequence
  derived and/or modified CDS sequence (wt) from DENV-3__FJ850089__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcauccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggagggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaacaugagaaccucaaauacaccgucaucaucacagugcacacaggagaucaacaccaggugggaaacgaaacgcagggagucacggcugagauaacaccucaggcaucaaccacugaagucaucuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcccacaauggcagacugauuacagccaacccaguggugacuaagaaggacgagccugucaauauugaggcugaaccuccuuuuggggaaaguaauauagugauuggaauuggagacaacgcuuugaaaaucaacugguauaagaaaggaagcucuauugggaagauguucgaggccacugccagaggugcaaggcgcauggccaucuugggagacacagccugggacuuuggaucagugggugguguucugaacucauuaggcaaaauggugcaccaaauauucggaagugcuuacacagcccuauucaguggagucucuuggguaaugaaagucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuuuauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuggagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguugggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggcuggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaauagugucaggagucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaagcagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagauuauugccguagagcccgggaagaacccaaagaacuuucaaaccaugccaggcacuuuucagacuacaacaggggaaauaggagcaauugcacuagauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacaaggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggcuaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcucauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcucauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccaccacaguaauaacaccaauguuaagacauaccauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagcuacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagccacaggaccaauaacaacacucugggaaggaucaccugggaaguuuuggaacaccacaauagcuguuuccauggcgaacaucuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaacuaucccggaaagaguuugaccuuuacaagaaaucuggaaucacugaaguggauagaacagaagccaaagaaggguugaaaagaggagaaacaacacaucaugccguguccagagguagcgcaaaacuccaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacucugggaaggaauaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagagguaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagagguuaaaaagaauggccauuagcggggaugauugcguagugaaaccaaucgaugacagguucgcuaaugcccugcucgcucugaacgauaugggaaagguucggaaggacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaaugccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7246 - RNA, 9873 nt, Artificial Sequence
  derived and/or modified CDS sequence (wt) from DENV-3__FJ850092__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcauccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggagggugugugacuaccauggcuaagaacaagccaacguuggauauagagcuucagaagaccgaggccacccaauuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaacaugagaaccucaaauacaccgucaucaucacagugcacacaggagaucaacaccaggugggaaacgaaacgcagggagucacggcugagauaacaccucaggcaucaaccacugaagucaucuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggaguuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuucguguugaagaaagaagucucagaaacgcagcaugggacaauacucauuaaggucgaguacaaaggggaagaugcaccuugcaagauuccuuucuccacagaggauggacaagggaaagcccacaauggcagacugauuacagccaacccaguggugacuaagaaggacgagccugucaauauugaggcugaaccuccuuuuggggaaaguaauauagugauuggaauuggagacaacgcuuugaaaaucaacugguauaagaaaggaagcucuauugggaagauguucgaggccacugccagaggugcaaggcgcauggccaucuugggagacacagccugggacuuuggaucagugggugguguucugaacucauuaggcaaaauggugcaccaaauauucggaagugcuuacacagcccuauucaguggagucucuuggguaaugaaagucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccaucgcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggagcaauggugugcuagagagugacaugaucaucccaaagagucuagcugguccuauuucgcaacacaaccacaggcccggguaccacacccagacggcgggacccuggcauuuaggaaaauuggagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguugggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaucguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaauagugucaggagucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaagcagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuagauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacaaggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaacaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcucauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcucauaccagaaccagaaaagcaaagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccaccacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagcuacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaacuaucccggaaagaguuugaccuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagaccuaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacucugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaucuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagagguaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagagguuaaaaagaauggccauuagcggggaugauugcguagugaaaccaaucgaugacagguucgcuaaugcccugcucgcucugaacgauaugggaaagguucggaaggacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7247 - RNA, 9873 nt, Artificial Sequence
  derived and/or modified CDS sequence (wt) from DENV-3__FJ850094__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcauccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggagggugugugacuaccauggcuaagaacaagccaacguuggauaucgagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauauaccgucaucaucacagugcacacaggagaucaacaccaggugggaaacgaaacgcagggagucacggcugagauaacaccucaggcaucaaccacugaagccaucuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacgggaacaccaaccuggaacaggaaggagcuucuugugacauuuaaaaacgcacaugcgaagaaacaagaaguaguaguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggacgagccugucaauauugaggcugaaccuccuuucggggaaaguaauauagugauuggaauuggagacaacgccuugaaaaucaacugguauaagaaaggaagcuccauugggaagauguucgaggccacugccagaggugcaaggcgcauggccaucuugggagacacagccugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauucucaugcauugcgauaggaaucauuacacucuaucugggagcuguggugcaagcugacaugggauguguuguaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacgaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggaguuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucagcagcugucaaggaugagagggccguacaugccgacaugggcuauuggauagaaagccaaaagaauggaaguuggaagcuagaaaaagcaucccucauagaggugaaaacuugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaaucagacccaucagugagaaagaagagaacaugguaaagucuuuagucucagcaggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaauugcucuggggcucauggcucuuaaacugauaacacaauuugaaacauaccaauuauggacagcacuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacauuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaauagugucaggagucuuuccauacuccauacccgcaacauuacuggucuggcauacuuggcaaaagcaaacccaaagaucuggcguucuaugggacgugcccagccccccagagacacagaaagcagaacuggaagaaggggucuauaggaucaagcagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaagguagugggacuguauggcaauggagugguuacaaagaaugguggcuacguuagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuugagaacucuaauuuuagcaccgacaagggugguugcagcugagauggaagaagcauugaaaggccucccaauaagguaccaaacaacagcaacaaaaucugaacacacaggaagagagauuguugaucuaaugugccacgcaacguuuaccaugcguuugcugucaccaguuaggguuccaaacuauaacuugauaauaauggaugaagcccauuucacagacccagccaguauagcggcuagaggguacauaucgacucguguuggaaugggagaggcagccgcaaucuucaugacagcaacgcccccuggaacagcugaugccuuuccucagagcaacgcuccaauucaagacgaagaaagggacauaccagaacgcucauggaauucaggcaaugaauggauaaccgacuucgcugggaaaacggugugguuuguccccagcauuaaagccggaaauggcauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuagacaacauuaauacaccagaaggaaucauaccagcucucuuugagccagaaagggagaagucagccgccauagacggugaguaccgcuugaaaggugagucuaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggcuacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcgaaagcuacucgcgaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccggggaaguuuuggaacaccacgauagcuguuuccauggcgaacaucuuuagagggagcuacuuagcaggagcugggcuugcuuuuucuauuaugaaaucaguuggaacaggaaaaagaggaacaggcucacaaggugaaacuuuaggagaaaaauggaaaaagaaauuaaaucaacuaucccggaaagaguuugaucuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaauauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucaguuaauaugguaucuagacugcuacugaacagguucacgaugacacacagaagacccaccauugagaaagauguggauuuaggagcaggaacucgacauguuaacgcggaaccagaaacacccaacauggaugucauuggggagagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaaaaaggucagaacuaaugcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaagggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugccagagaagaaaaucacacaaugguuggagaccaaaggaguggagagguuaaaaagaauggccauuagcggggaugauugcguagugaaaccaaucgaugacagguucgcuaaugcccugcucgcucugaacgauaugggaaagguucggaaagacauaccacaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucaauucaugcucaccaucaguggaugaccacagaagacaugcuuacugucuggaacaggguguggaucgaggacaauccauggauggaagacaaaacuccaguuacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggaaggagccauuugguaa

SEQ ID NO: 7248 - RNA, 9873 nt, Artificial Sequence
  derived and/or modified CDS sequence (wt) from DENV-3__FJ898446__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgagaccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccaguggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaaaagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaagugcggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7249 - RNA, 9873 nt, Artificial Sequence
  derived and/or modified CDS sequence (wt) from DENV-3__GU131844__SS-prME
acaucgcucugccucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagcuuggaggcaagucgagaagguagagacaugggcccuuaggcacccaggguucaccauacuagcucuauuucuugcccauuacauaggcacauccuugacccagaaggugguuauuuuuauacuacuaaugcuggucaccccauccaugacaaugagaugugugggagugggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaacuaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaagggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuagguaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucuaggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaaugucaaauuaacgguaguugugggcgauauaauuggggucuuagagcaaggaaaaagaacacuaacaccacaacccauggagcugaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuuuacguuugugcuccuucucucagggcaaauaacauggagagacauggcgcacacacuaauaaugauuggguccaacgcaucugacaggaugggaaugggcguuaccuaccuagccuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuaucuuuagcuugaaagacacacucaaaaggagaagcuggccacugaaugaaggggugauggcuguugggcuugugagcauuuuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacgggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauuaaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagagcgcucauggaauucaggcaaugaauggauaaccgacuucgcugggaaaacggugugguuuguccccagcauuaaagccggaaaugacauagcaaacugcuugcgaaaaaacgggaaaaaggucauccaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagcugccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcucuucuuaauaucagguaaagggauuggaaagacuucaauaggacucauuuguguaauugcuuccaguggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaacgaaaugggauuguuggaaacuacaaaaagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagccauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcagcucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguacccauguccacauauggauggaacauaguuaaguuaaugaguggaaaggauguguuuuaucuuccaccugaaaagugugacacccuguugugugacauuggagaaucuucaccaagcccaacgguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauuaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugccagagaagaaaauugcacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggaucgggauggagccuuagagaaaccgcaugucuggggaaagccuacgcucaaauguggagucucauguauuuucacagaagagaccucagacuagcauccaacgccauauguucagcuguaccaguccacuggguccccacaaguagaacgacauggucuauucaugcucaccaucaguggaugaccacagaagacaugcuugcugucuggaauaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7250 - RNA, 9873 nt, Artificial Sequence
  derived and/or modified CDS sequence (wt) from DENV-3__GU131849__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacgucaacaugggugacuuacggaacgugcaaucaagccggagagcgcagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuacuauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccauugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagauacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaauguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaagguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaggccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacguaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacucucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7251 - RNA, 9873 nt, Artificial Sequence
  derived and/or modified CDS sequence (wt) from DENV-3__GQ868546__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguggacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguagaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7252 - RNA, 9873 nt, Artificial Sequence
  derived and/or modified CDS sequence (wt) from DENV-3__GU131850__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugauuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacauaggauguguuauaaacuggaaaggcaaagaacucaaauguggaaguggaaucuuugucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucacugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuugugucuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucagaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuauuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucguugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaacagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaaaaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggggaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggauagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7253 - RNA, 9873 nt, Artificial Sequence
  derived and/or modified CDS sequence (wt) from DENV-3__GU131851__SS-prME
acaucgcucugucucgugaugauauugccagcagcacuugcuuuccacuugacuucacgagauggagagccgcacaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaauggcuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuucgcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggaugggcaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauucucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccauuauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaaggguaguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaucccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7254 - RNA, 9873 nt, Artificial Sequence
  derived and/or modified CDS sequence (wt) from DENV-3__GQ868547__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacacgcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauggugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagaggugcacacccaacuaugugaccauaggcuaaugucggcagcugucaaggaugagagggccguacaugccgacaugggcuauuggauagaaagccaaaagaauggaaguuggaagcuagaaaaagcaucucucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaccaauuauggacagcauuaaucuccuuaacguguucaaauacaauguuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgauccaagaagaugucucaaaccagugauccugacagauggaccagagcgggugauccuggcuggaccaaugccagucaccgcggcgagugcugcgcaaaggagagggagaguugguaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagaaacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacgguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaagggcugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaucccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguugaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7255 - RNA, 9873 nt, Artificial Sequence
  derived and/or modified CDS sequence (wt) from DENV-3__GU131857__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucguugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7256 - RNA, 9873 nt, Artificial Sequence
  derived and/or modified CDS sequence (wt) from DENV-3__GU131858__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaagauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugauuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacauaggauguguuauaaacuggaaaggcaaagaacucaaauguggaaguggaaucuuugucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagcggcccaucacugacaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuugugucuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuauuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucguugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaacagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggggaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggauagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7257 - RNA, 9873 nt, Artificial Sequence
  derived and/or modified CDS sequence (wt) from DENV-3__GQ868548__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcagcaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucguugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7258 - RNA, 9873 nt, Artificial Sequence
  derived and/or modified CDS sequence (wt) from DENV-3__GU131861__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucugggaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgaaaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguauugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaaggaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaacggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaaaagacguuuaagaacucuaauuuuggcaccgacaagggugguugcagcugagauggaagaagcauugaaagggcucccaauaagguaccaaacaacaguaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuguaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuaucuagcaggagcugggcuugcuuuuucuauuaugaaaucaguuggaacaggaaaaagaggaacaggcucacaaggugaaacuuuaggagaaaaauggaaaaggaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguacccauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaagaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaaccccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7259 - RNA, 9873 nt, Artificial Sequence
  derived and/or modified CDS sequence (wt) from DENV-3__GU131862__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugauuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacauaggauguguuauaaacuggaaaggcaaagaacucaaauguggaaguggaaucuuugucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucacugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuugugucuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuauuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucguugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagauccuuuagcacucaaggaauucaaggacuuugcggcuggcagaaagucaaucacccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaacagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggggaucacagcggaguggcucuggaaaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggauagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7260 - RNA, 9873 nt, Artificial Sequence
  derived and/or modified CDS sequence (wt) from DENV-3__GU131865__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucugggaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgaaaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaacggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaaaagacguuuaagaacucuaauuuuggcaccgacaagggugguugcagcugagauggaagaagcauugaaagggcucccaauaagguaccaaacaacaguaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuguaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuaucuagcaggagcugggcuugcuuuuucuauuaugaaaucaguuggaacaggaaaaagaggaacaggcucacaaggugaaacuuuaggagaaaaauggaaaaggaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguacccauguccacauauggauggaacauaguuaaguuaaugacuggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaaguccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaaccccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7261 - RNA, 9873 nt, Artificial Sequence
  derived and/or modified CDS sequence (wt) from DENV-3__GU131866__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacaucaccgaaguggaaccugaagacauugacugcuggugcaaccuuacaucaacaugggugacuuacggaacgugcaaucaagccggagagcguagacgcgacaggagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacaucuuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagauagaggcugggggaacggaugugguuuguuuggcaagggaagcuugguaacaugugcgaaauuucaaugccuggaacuaauagagggaaaaguggugcaguaugagaaccucaaauacaccgucaucaucacagugcacacaggggaucaacaccaggugggaaaugaaacgcagggaguuacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugauaugggauguguuauaaacuggaaaggcaaagaacucaaauguggaaguggaaucuucgucaccaacgagguccaugccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaauuaugugaccauaggcuaaugucggcagcugucaaggaugagagggccguacaugccgacaugggcuauuggauagaaagccaaaagaauggaaguuggaaauuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggauuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauucuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagcuacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacacugcuggucuggcauacuuggcaaaagcaaacccaaagauccggcguucuaugggacguacccagucccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagcccgggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggaguaguuacaaagaaugguggcuaugucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagagcgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuuuguggaacucaugaggaggggugaccuuccagucugguuagcccauaaaguagcaucagaagggaucaaauauacagauagaaaauggugcuucgauggacaacguaauaaucaaauuuuagaggagaacauggauguggaaaucuggacaaaggaaggagaaaagaaaaaauugaggccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcuuuggacaaucuggugaugcugcauacgucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagacuucaauaggacucaucuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuauuggaaacuacaaagagagauuuaggaaugucuaaggagccaggugucgucucuccaaccagcuauuuagauguggacuugcauccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucucggaaagaguuugaccuuuacaagaaaucuggaaucacugaaguggauagaacagaagcuaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaggaaccaguacccauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugagccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuauugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucaugggaaucacagcggaguggcucuggagaacccugggaaggaacaaaaagcccagguuaugcacaagggaagaguucacaaagaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggaaguuagcgaacgcuauauuuaagcucacauaccaaaacaaaguggucaaaguucaacgaccgacuccaacaggcacgguaauggacaucauaucuaggaaagaccaaagaggcagugggcagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucagauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7262 - RNA, 9873 nt, Artificial Sequence
  derived and/or modified CDS sequence (wt) from DENV-3__GU131868__SS-prME
acaccgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaauguccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaauauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaacuaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaauaacgcacaugcgaagaaacaagaaguaguuguccuuggaucgcaagagggagcaaugcauaccgcauugacaggagccacagaaauccaaaacucaggaggcacaaguauuuuugcggggcauuugaaauguagacuuaagauggauaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagauugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaauuauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccucuggaagcaaauagccaaugaacugaacuacauauugugggaaaacaauaucaaauuaacaguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccuaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucucauuaacguguucaaauacaauguucacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauugguggccgggggcuuacugauagcgugcuacgucauaacuggcacgucagcggaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagugcacaauggcaaaaaggggaggaagugcagguuauugccguagagccugggaagaauccaaagaacuuucaaaccaugccaggcacuuuucagacuacaacaggggaaauaggagcaauugcacuagauuucaagccuggaacuucaggaucucccaucauaaacagagagggaaagguagugggacuguauggcaauggagugguuacaaagaaugguggcuacgucagcggaauagcgcaaacgaaagcagaaccagauggaccgacaccagaauuggaagaagagauguucaaaaagcgaaaucuaacuauaauggaucuucauccugggucaggaaagacacggaaauaccuuccagcuauuguuagagaggcgaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcauccgcaauuuucaugacagcaacgcccccuggaacagcugaugccuuuccucagagcaaugcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaacaaugaugaagaccaugcucacuggacagaagcaaaaaugcugcuggacaacauuaauacaccagaagggaucauaccagcucucuuugagccagaaagagagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuugauaucagguaaagggauuggaaagacuucaauaggacucauuuguguaauugcuuccagcgguauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccaaguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggauaaaggauggccaauaucaaaaauggacuuaggaguaccccuacuggcauuggguugcuauucacaagugaacccacugacucuaacagcggcaguauucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaagucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagagggggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgccucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucguaaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcauaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacaggugggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacggaagacaugcuuaccgucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaauauacccacagcaauucaacaggugagaagccuuauaggcaaugaagaguuucuggacuacaugccuucaaugaagagauuuaggaaggaggaggagucggagggagccauuugguga

SEQ ID NO: 7263 - RNA, 9873 nt, Artificial Sequence
  derived and/or modified CDS sequence (wt) from DENV-3__GU131869__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguggacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacauagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuagcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaagaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggagaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7264 - RNA, 9873 nt, Artificial Sequence
  derived and/or modified CDS sequence (wt) from DENV-3__GU131870__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcauccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagaaggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaaccacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaaaucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauugcuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaucguagaaaaagcagcagacauaacaugggaggaagaggcugagcaaacaggagugucccauaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaccuucauccugggucaggaaagacacggaaauaccuuccagcuauuauuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaauauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcgguauguuguggauggccgaaaucccacuccaauggauugcgucggcuauaguccuggaguuuuuuaugaugguguugcuuauaccagaaccagaaaaacagagaaccccccaagacaaccaacucgcauaugucgugauaggcauacucacuuuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcaguggucuugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccacuauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggggaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccuggucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7265 - RNA, 9873 nt, Artificial Sequence
  derived and/or modified CDS sequence (wt) from DENV-3__GU131871__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucugggaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgaaaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaacaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacacacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuaucuagcaggagcugggcuugcuuuuucuauuaugaaaucaguuggaacaggaaaaagaggaacaggcucacaaggugaaacuuuaggagaaaaauggaaaaggaaauuaaaccaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauuguagcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaaccccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7266 - RNA, 9873 nt, Artificial Sequence
  derived and/or modified CDS sequence (wt) from DENV-3__GU131872__SS-prME
acaucgcucugucucgugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaaguugagaagguagagacaugggcccuuaggcacccaggguucaccauauuagcccuauuucuugcccauuacauaggcacauccuugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccccuaccauggacaucaggagcuacaacggaaacaccaaccuggaacaggaaggagcuucuugugacauuuaaaaacgcacacgcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauccucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauggugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacacgccgacaugggcuauuggauagaaagccaaaagaauggaaguuggaagcuagaaaaagcaucucucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacagaaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaccaauuauggacagcauuaaucuccuuaacguguucaaauacaauguuuacgcugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccacugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacacaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccacgccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacaaaugcagaaccagauggaccaacaccagaauuggaagaagagauguucaaaaagcgaaaucuaaccauaauggaucuucauccugggucaggaaagacacggaaauaccuuccagcuauuaucagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgauccaagaagaugucucaaaccagugauccugacagauggaccagagcgggugauccuggcuggaccaaugccagucaccgcggcgagugcugcgcaaaggagagggagaguugguaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagaaacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaauguccaaggagccagguguugucucuccaaccagcuauuuagauguggacuugcacccagcaucagccuggacauuguaugccguggccacuacgguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaauugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguggauagaacagaagccaaagaagggcugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaucccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggugauggagaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguugaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauauuuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7267 - RNA, 9873 nt, Artificial Sequence
  derived and/or modified CDS sequence (wt) from DENV-3__GU131873__SS-prME
acaucgcucugucucaugaugauauugccagcagcacuugcuuuccacuugacuucacgagauggagagccgcgcaugauugugggaaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucgguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcucauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguauguaagcauacauacguagacagaggcugggggaacggaugugguuuguuuggcaagggaagcuugguaacaugugcgaaauuucaaugccuggaacuaauagagggaaaaguggugcaguaugagaaccucaaauacaccgucgucaucacagugcacacaggagaucaacaccaggugggaaaugaaacgcagggaaucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucauaacggcagacugauuacagccaacccaguggugacuaagaaggaggagccugucaauauugaggcugaaccuccuuuuggggaaaguaacauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauacugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguuuggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagaguuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacgugcucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugcuguagagccugggaagaacccaaagaacuuucaaaccaugccaggcacuuuucagacuacaacaggggaaauaggagcaauugcacuggauuucaagccuggaacuucaggaucucccaucauaaacagagaggguaagguagugggacuguauggcaauggagugguuacaaagaaugguggcuacgucagcggaauagcgcaaacgaaugcagaaccagauggaccgacaccagaauuggaagaagagauguucaaaaagcgaaaccuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauccaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaaugggaaaaaggucauucaacuuaguaggaagacuuuugacacagaauaucagaaaacuaaacugaaugauugggacuucguggugacaacugacauuucagaaaugggugccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacguuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuucgauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucauaauaucagguaaagggauuggaaagacuucaauaggacucauuuguguaauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccaggugucgucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcaguggucuugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacuacuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaacccuuacaaaacgugggcuuaccauggaucuuaugaagucaaagccacaggcucagccuccuccaugauaaauggagucgugaaacuucucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauuuaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucugggaaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7268 - RNA, 9873 nt, Artificial Sequence
  derived and/or modified CDS sequence (wt) from DENV-3__GU131874__SS-prME
acaucgcucugccucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagcuuggaggcaagucgagaagguagagacaugggcccuuaggcacccaggguucaccauacuagcucuauuucuugcccauuacauaggcacauccuugacccagaaggugguuauuuuuauacuacuaaugcuggucaccccauccaugacaaugagaugugugggagugggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaacuaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaagggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuagguaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucuaggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcugaaauacucauggaaaacguggggaaaggcaaaaauagugacagcugaaacacaaaauuccucuuucauaauagacgggccgaacacaccggaguguccaaguaccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggagcaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuuuacguuugugcuccuucucucagggcaaauaacauggagagacauggcgcacacacuaauaaugauuggguccaacgcaucugacaggaugggaaugggcguuaccuaccuagccuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuaucuuuagcuugaaagacacacucaaaaggagaagcuggccacugaaugaaggggugauggcuguugggcuugugagcauuuuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacgggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauuaaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagagcgcucauggaauucaggcaaugaauggauaaccgacuucgcugggaaaacggugugguuuguccccagcauuaaagccggaaaugacauagcaaacugcuugcgaaaaaacgggaaaaaggucauccaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagcugccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcucuucuuaauaucagguaaagggauuggaaagacuucaauaggacucauuuguguaauugcuuccaguggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaacgaaaugggauuguuggaaacuacaaaaagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagccauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcagcucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcucgcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcgaaacuccaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguacccauguccacauauggauggaacauaguuaaguuaaugaguggaaaggauguguuuuaucuuccaccugaaaagugugacacccuguugugugacauuggagaaucuucaccaagcccaacgguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauuaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaagacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugccagagaagaaaauugcacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaauuggugguucccugcagaccccaggacgaacuaauaggaagagcaagaaucucucaaggaucgggauggagccuuagagaaaccgcaugucuggggaaagccuacgcucaaauguggagucucauguauuuucacagaagagaccucagacuagcauccaacgccauauguucagcuguaccaguccacuggguccccacaaguagaacgacauggucuauucaugcucaccaucaguggaugaccacagaagacaugcuugcugucuggaauaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggaaggagccauuugguaa

SEQ ID NO: 7269 - RNA, 9873 nt, Artificial Sequence
  derived and/or modified CDS sequence (wt) from DENV-3__GU131875__SS-prME
acaucgcucugucucgugaugauauugccagcagcacuugcuuuccacuugacuucacgagauggagagccgcgcaugauuguggggaagaaugaaagaggaaaaucccuacuuuucaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauauuagcccuauuucuugcccauuacauaggcacaucccugacccagaaggugguuauuuuuauacuacuaaugcuggucaccccauccaugacaaugagaugugugggaguaggaaacagagauuuuguagaaggucuaucaggagcuacguggguugacguggugcucgagcacggggggugugugacuaccauggcuaagaacaagccaacguuggauauagagcuucagaagaccgaggccacccaauuggcgacccuaaggaaacuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauuaacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcacccugcaagauuccuuucuccacagaggauggacaagggaaagcucacaauggcagacugaucacagccaacccaguggugacuaagaaggaggagccugucaauaucgaggcugaaccuccuuuuggggaaaguaauauagugauuggaauuggagacaacgccuugaaaaucaauugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaauucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaacaucaaauuaacgguaguugugggcgacauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucggcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuauuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagcugcaauuuucaugacagcaacgcccccuggaacagcugaugccuuuccccagagcaacgcuccaauucaagaugaggaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaaguagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcccucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaaacagagaaccccccaagacaaccaacucgcauaugucgugauaggcauacucacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaccaauuaucccggaaagaguuugaccuuuacaagaaaucuggaaucacugaaguagauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcaggacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguauuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagaguuuuuaaagagaaaguggacaccaggacacccagguccaugccaggaacaagaagggucauggggaucacagcggaguggcucuggagaacccugggaaggaacaaaaaacccaggcuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgggaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgagcuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7270 - RNA, 9873 nt, Artificial Sequence
  derived and/or modified CDS sequence (wt) from DENV-3__GU131877__SS-prME
acaucgcucugucucaugaugauauugccagcagcacuugcuuuccaccugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuugguaaaggaagcuugguaacaugugcgaaauuucaaugccuggaaccaauagaggggaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauucccuucuccacagaggauggacaagggaaagcucacaauggcagacugauuacagccaacccagugguaacuaagaaggaggagccugucaauaucgaggcugaaccuccuuuuggggaaaguaauauagugauuggaauuggagacaacgccuugaaaaucaauugguauaagaaaggaagcucuauugggaagauguucgaggccacugccagaggugcaaggcgcauggccaucuugggagacacagcuugggacuucggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauugggguuuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacgaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagagguaaaaaccugcacauggccaaaaucacauacccuuuggaguaacggugugcuagagagugauaugaucaucccaaagagucuagcugguccuauuucgcaacacaaccacaggcccggguaccacacccagacagcgggacccuggcauuuaggaaaauuagagcuggacuucaacuauugugaaggaacaacaguugucaucacagaaaacugugggacgagaggcccaucauugagaacaacaacagugucagggaaguuaauacacgaaugguguugccguucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuugguaauccucuuugaagaggugaugagaggaaaauuugggaagaagcacaugauugcggggguguucuucacguuugugcuccuucucucagggcaaauaacauggagagacauggcgcacacacuaauaaugauuggguccaacgcaucugacaggaugggaaugggcguuaccuaucuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcccuggggcucauggcucucaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaauaucaggagucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggaguggucacaaagaaugguggcuaugucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuauuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucucugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauacacagauagaaaauggugcuuugauggacaacguaauaaucaaauuuuagaagagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggcuuacaggcaugcaguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacgcauuaugcuaucauagguccaggauugcaggcaaaagccacucgugaagcucagaaaaggacagccgcuggaauaaugaagaauccaacgguggaugggauaaugacaauagaccuagauccugugauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcuggacuugcuuuuucuauuaugaaaucaguuggaacaggaaaaagaggaacaggcucacaaggugaaacuuugggagaaaaauggaaaaagaaauuaaaucaauugucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguagugcccauggugauacagauggcaaugacagauacaacuccauuuggccagcagagaguuuuuaaagagaagguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuuuacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaaacucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaauggcuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacagaguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuagaaaggaggaggagucggagggagccauuugguaa

SEQ ID NO: 7271 - RNA, 9873 nt, Artificial Sequence
  derived and/or modified CDS sequence (wt) from DENV-3__GU131878__SS-prME
acaucgcucugccucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuggcuccccaugucggcaugggacuagacacacgcacccaaaccuggaugucggcugaaggagccuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggagugggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaacuaauagagggaaaaguggugcaguaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaauguagacuuaagauggacaaauuggaacucaaagggaugagcuaugcaaugugcacgaauaccuuuguguugaagaaagaagucucagaaacgcagcaugggacaauacucaucaaggucgaguacaagggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaacuggagacaacgcuuugaaaaucaacugguauaagaaaggaagcucuauugggaagauguucgaggccacugccagaggugcaaggcgcauggccaucuugggagacacagcuugggacuuuggaucagugggugguguucugaacucauuagguaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucuaggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcugaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauuaagaacaacaacagugucagggaaguuaauacacgaaugguguugccguucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuuuacguuugugcuccuucucucagggcaaauaacauggagagacauggcgcacacacuaauaaugauuggguccaacgcaucugacaggaugggaaugggcguuaccuaccuagccuuaauugcaacauuuaaaauccagccauucuuggcuuuaggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuaucuuuagcuugaaagacacacucaaaaggagaagcuggccacugaaugaaggggugauggcuguugggcuugugagcauuuuggccaguucucuccuuagaaaugauguacccauggcuggaccauugguggccgggggcuugcuaauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacgggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggcaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccagucaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagagcgcucauggaauucaggcaaugaauggauaaccgacuucgcugggaaaacggugugguuuguccccagcauuaaagccggaaaugacauagcaaacugcuugcgaaaaaacgggaaaaaggucauccaacuuagcaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaaggcaucauaccagcucucuuugagccagaaagggagaagucagcugccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuugcugacagguggagcaaugcucuucuuaauaucaggcaaagggauuggaaagacuucaauaggacucauuuguguaauugcuuccaguggcauguuguggauggccgcaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaacgaaaugggauuguuggaaacuacaaaaagagauuuaggaaugucuaaggagccaggcguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaauaacacaucaugccguguccagagguagcgcaaaacuucaaugguucguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaaccauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaaggguuauggggaucacagcggaguggcucuggagaacccugggaagaaacaaaaaacccagguuaugcacaagggaagaguucacaaaaaaggucagaacuaacgcagccaugggcgccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugccagagaagaaaauuacacaaugguuggaaacuaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugccuggggaaagcuuacgcucaaauguggagucucauguauuuucacagaagagaccucagacuagcauccaacgccauauguucagcuguaccaguccacuggguccccacaaguagaacgacauggucuauucaugcucaccaucaguggaugaccacagaagacaugcuuacugucuggaauaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7272 - RNA, 9873 nt, Artificial Sequence
  derived and/or modified CDS sequence (wt) from DENV-3__FJ898455__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaauguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguagaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaauaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauccuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugaacaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacacaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaccuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaggaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguaugcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggggaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagaaaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagacauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7273 - RNA, 9873 nt, Artificial Sequence
  derived and/or modified CDS sequence (wt) from DENV-3__GQ199891__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacucaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggaaccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaauuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaacgggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguag

SEQ ID NO: 7274 - RNA, 9873 nt, Artificial Sequence
  derived and/or modified CDS sequence (wt) from DENV-3__FJ898443__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaacuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggaguuucuuggguaaugaaaauuggaauaggaguucucuugacuuggauagguuugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugcaucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaauuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacccguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaagccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucaacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccgguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaugaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgacaugggaaagguucggaaagacauaccucaauggcagccaucuaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcaucuaacgccauauguucagcaguuccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggaguuggagggagccauuugguaa

SEQ ID NO: 7275 - RNA, 9873 nt, Artificial Sequence
  derived and/or modified CDS sequence (wt) from DENV-3__FJ898444__SS-prME
acaucgcuuugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacgugggucgacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuccuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaguuagaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggaugaacaagggaaagcucacaauggcagacugauuacagccaacccaguggugacuaagaaggaggagccugucaauaucgaggcugaaccuccuuucggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucgaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaagggaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaguggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaaucuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagccaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccagguagggguuggaguacagaaagaaggagucuuucauaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugcuguagagccugggaagaacccaaagaacuuucaaaccaugccaggcacuuuucagacuacaacaggggaaauaggagcaauugcacuggauuucaagccuggaacuucaggaucucccauuauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcacaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucggaagggaucaaauauacagauagaaaauggugcuuugauggacaacguaauaaucaaauuuuagaagagaacauggauguggaaaucuggacaaaggaaggagagaagaaaaaauugagaccuagguggcuugaugcccgcacauauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcucauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuagggagccagguguuguuucuccaaccagcuauuuagauguggacuugcacccagcaucagccuggacauuguacgcuguggccaccacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugagaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaaccuuaggagaaaaauggaaaaagaaguuaaaucaauuaucccggaaagaguuugaccuuuacaagaaaucuggaaucacugaaguggacagaacagaagccaaagaaggguugaaaaaaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggggaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagauucacgaugacacacagaagacccaccauugagaaagauguggauuuaggagcaggaacucgacaugucaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuucaaagagaaaguggacaccaggacacccaggcccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguucggcaaagcaaaaggcaguagagcaauaugguacaugugguugggagccagguaccuugaguucgaagcccuuggauucuuaaaugaagaccacugguuuucgcgugagaacucuuacaguggaguggaaggagaaggacugcacaagcuaggcuauauauuaagggacauuuccaaaauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcuugcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaacccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7276 - RNA, 9873 nt, Artificial Sequence
  derived and/or modified CDS sequence (wt) from DENV-3__FJ898445__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagcuauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagauccguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuacauuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucaaaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuagacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauuaacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcaacaugggacaauacucaucaaggucgaguacaaaggggaagauguaccuugcaagauuccuuucuccacagaggauggacaagggaaagcucacaauggcagacugauuacagccaacccaguggugacuaagagggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucuaggagcuguggugcaagcugacaugggguguguuauaaacuggaaaggcaaagaacucaaauguggaaguggaaucuucgucaccaacgagguccacaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauggaaagccaaaagaauggaaguuggaagcuagaaaaagcgucccucauagaggugaaaaccugcacauggccaaaaucacauacccuuuggaguaaugguguguuagagagugacaugaucauuccaaagagucuagcuggucccaucucgcaacacaacuacaggcccggguaccacacccagacggcgggacccuggcaucuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugaucgcggggguuuucuucacguuuguacuccuucucucagggcaaauaacauggagagauauggcgcacacacuaauaaugauugggucuaacgcaucugacaggaugggaaugggcguuaccuaccuagcuuuaauugcaacauuuaaaauccagccauucuuggcuuugggauucuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugacguacccauggcuggaccauuaguggcugggggcuuguugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccuggaaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucgcguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacaagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggaauguuggaaacuacaaagagagauuuaggaaugucuaaggagccagguguugcuucuccaaccagcuauuuagauguggacuugcacccagcaucagccuggacauuguacgcuguggcuacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaaguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacagguucagccuccuccaugauaaauggagucgugaaacuccucacuaaaccaugggauguggugcccauggugauacagauggcaaugacagauacaacuccauuuggccagcagagagucuuuaaagagaaaguggacacuaggacacccagguccaugccaggaacaagaaggguuauggggaucacagcggaguggcucuggagaacccugggaaggaacaaaaaacccagguuaugcacaagggaagaguuuacaagaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacauguggcugggagccagguaccuugaauucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacguaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaaaguucggaaagacauaccucaauggcagccaucaaagggauggcaugauuggcaacagguuccuuucugcucccaccauuuucaugaauugaucaugaaagauggaagaaaguuggugguucccugcagaccccaggacgaacuaauaggaagagcaagaaucucucaaggagcgggauggagccuuagagaaaccgcaugucuggggaaagcuuacgcucaaauguggagucucauguauuuucacagaagagaccucagacuagccuccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7277 - RNA, 9873 nt, Artificial Sequence
  derived and/or modified CDS sequence (wt) from DENV-3__GQ868571__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagauagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaacauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauugggucuaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggagcuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggaauguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacaugucaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaagucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgccaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7278 - RNA, 9873 nt, Artificial Sequence
  derived and/or modified CDS sequence (wt) from DENV-3__GU131951__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuacggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggccuaucaggagcuacguggguugacguggugcucgagcacggggggugugugaccaccaugucuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacucuugggcuagaaugcucaccacggacagguuuggacuucaaugaaaugaucuugcuaacaaugaagaacaaagcauggaugguacauagacaaugguuuuuugaccugccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcucuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauucaaaauccagccauucuuggcuuugggauuuuuucuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacucuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuuaaaaacagcauuacuaauaguaucaggaaucuuuccauacuccauacccgcaacauuguuggucuggcauacuuggcaaaagcaaacccaaagauccggcguucuaugggauguaccuagcccuccagaggcacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuccagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaagacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugaucuugacagauggaccagaacgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcccauagaacgagaaacgcucuggacaaucuggugaugcugcauacgucagaacauggcgguaaggccuacagacaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagcuaaccaggcagugguccugauggguuuggacaaaggauggccaauaucaaaaauggacuuaggaguaccccuacuggcauuggguugcuauucacaggugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacuucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaagucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguagauagaacagaagccaaagaaggguugaaaagaggagaaauaacacaucaugccguguccagagguagcgcaaaacuucaaugguuuguggagagaaacauggucacucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacacuguugugugacauuggagaaucuucaccaagcccaauaguggaagaaagcagaacuauaagaguuuugaagauggucgaaccauggcuaaagaauaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggacuuaggagcaggaacucgacauguuaaugcggaaccagaaacacccaacauggaugucauuggggaaagaauaaaaaggaucaaggaggagcauaauucaacauggcacuaugaugacgaaaaccccuauaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaaccaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaacgcccugcucgcucugaacgauaugggaaagguucggaaagacauaccucaauggcagccaucaaagggauggcaugauuggcagcagguuccuuucugcucccaccacuuucaugaauugaucaugaaagauggaagaaaguuggugguucccuguagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguucccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuaggaaagagagaagaccaauggugcggaucacuuauuggucucacuuccagagcaaccugggcccagaacauacccacagcaauucaacaggugaggagccuuauaggcaaugaagaguuucuggacuacaugccuucaaugaagagauuuaggaaggaggaggagucggagggagccauuugguaa

SEQ ID NO: 7279 - RNA, 9873 nt, Artificial Sequence
  derived and/or modified CDS sequence (wt) from DENV-3__GQ868572__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacguguaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacgggugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagcuacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaaguucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggaguuucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacuuaaauguggaaguggaaucuucgucaccaacgagguccauaccuggacagagcaauacaaauuccaagcagacuccccaaaaagauuggcgacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugcgggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggaguaguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuauccaggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaauuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7280 - RNA, 9873 nt, Artificial Sequence
  derived and/or modified CDS sequence (wt) from DENV-3__GQ868573__SS-prME
acaucguucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcggucuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacgccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuucgaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuagguaaaauggugcaccaaauauucggaagugcuuacacagcccuauucaguggagucucuugggugaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaaucaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguuuggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacucuuuggaguaaugguguguuagagagugacaugaucauuccaaagagucuagcugguccuaucucgcaacacaacuacaggcccggguaccacacccagacggcgggacccuggcauuuaggaaaauuggagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucugggacucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccggugugccagucuucgagcaugaggaaaacagacuggcuuccaaugacaguggcagcuaugggacuuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagauuugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaagguagugggacuguauggcaauggaguggucacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaagccacaggcucagccuccuccaugauaaauggagucgugaaacuccucacuaaaccaugggauguggugcccauggugacgcagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgagaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguuugcuaaugcccugcucgcucugaacgacaugggaaagguucggaaagacauaccucaauggcagccgucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuaccgucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7281 - RNA, 9873 nt, Artificial Sequence
  derived and/or modified CDS sequence (wt) from DENV-3__GQ868574__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagcuauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauauuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggauaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcaucuaggaaaauuagagcuggacuucagcuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauugggucuaacgcaucugacaggaugggaaugggcguuaccuaccuagcuuuaauugcaacauuuaaaauccagccauucuuggcuuugggauucuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucgcguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugagaaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaacugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggaacuaccagagacaauggaaacacuccuacucuugggacucaugauuuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggaauguuggaaacuacaaagagagauuuaggaaugucuaaggagccagguguugcuucuccaaccagcuauuuagauguggacuugcacccagcaucagccuggacauuguacgcuguggcuacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaauucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagccuccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7282 - RNA, 9873 nt, Artificial Sequence
  derived and/or modified CDS sequence (wt) from DENV-3__GQ868575__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuucggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuuuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaauuucacaauggguguccuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugaucggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuggcuuaaaagacacacucaaaaggagaagcuggccacugaaugaaggggugauggcuguugggcuugugagcauucuggccaguucucuccuuagaaaugauguacccauggcuggaccauuaguggcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauaccuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccgggcacuuuucagacuacaacaggggaaauaggagcaauugcacuggauuucaagccuggaaccucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccucccagucugguuagcccauaaaguagcaucagaagggaucaaauauacagauagaaaauggugcuuugauggacaacgcaauaaccaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuagggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacccuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcaugaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaauacccaacauggaugucauuggggaaagaauaaaaaggaucaaggaggagcauaauucaacauggcacuaugaugacgaaaacccuuacaaaacgugggcuuaccauggaucuuaugaagucaaagccacaggcucagccuccuccaugauaaauggagucgugaaacuccucacuaaaccaugggacguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaaugcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccaacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgacaugggaaagguacggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaacugcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7283 - RNA, 9873 nt, Artificial Sequence
  derived and/or modified CDS sequence (wt) from DENV-3__GU131953__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagccuacguuggacauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggggcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugcuguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccuuuuugaagaggugaugagaggaaaauuugggaagaaacacaugauugcggggguuuucuucacguuuguacuccuccucucagggcaaauaacauggagagauauggcgcacacacuaauaaugauuggguccaacgcaucugacaggaugggaaugggcguuaccuaccuggcuuuaauugcaacauuuaaaauccagccauucuuggcuuugggauuuuuccuaagaaaacugacauccagagaaaauuuauuguuaggaguugggcuggcuauggcaacaacguuacaacugccagaagacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguagcugggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcauguuacaagaggggcaguauugacauauaaugggaaaagacuggaaccaaacugggcuagcgugaaaaaagaucugauuucauacggaggaggauggagauugagcgcacaauggcaaaagggggaagagguacagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaacuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccagcauagcugccagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaaugggaaaaaggucauucaacuuaguaggaagacuuuugacacagaauaucagaaaacuaaacugaaugauugggacuuuguggugacgacugacauuucagaaaugggggccaauuucaaagcagacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucaggaaaagggauuggaaagacuucaauaggacucauuuguguaauugcuuccagcggcauguuguggauggccgaaaucccacuccaauggaucgcgucggccauaguccuggaguuuuucaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcuguuggcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccagcuaaucagacaaauggaaggagaaggugugcugucaaaggcagaccucgagaacccucaucugucagagaagaaaguuacacaaugguuggaaaccaaaggaguggagagguuaaaaagaauggccauuagcggggaugauugcguagugaaaccaaucgaugacagguucgcuaaugcccugcucgcucugaacgacaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguuccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7284 - RNA, 9873 nt, Artificial Sequence
  derived and/or modified CDS sequence (wt) from DENV-3__GQ868577__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaucucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacgugggucgacguggugcucgagcacggggggugugugaccaccauggccaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuuggguuagaaugcucaccacggacagguuuggacuucaaugaaaugaucuugcuaacaaugaagaacaaagcauggaugguacacagacaaugguucuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacggaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucucuacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacucccccaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagagaaagcaucccucauagaggugaaaaccugcacauggccuaaaucacacacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauugggucuaaugcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauuuuuacguugacuguugccuggagaacagccacccugauuuuggccggaguuucgcucuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguaccuauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuucugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaaguuauugccguagagccugggaaaaacccaaagaacuuucaaaccaugccaggcacuuuucagacuacaacaggggaaauaggagcaaucgcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguuuaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagcugcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuucuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuucgcagcugguagaaagucaauagcccuugaucuugugacagaaauaggaagagugccuacacaccuagcucauagaacgagaaacgcucuggacaaucuggugaugcugcauacaucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcucauaccagaaccagaaaagcagagaaccccccaagacaaccaacucgcauacgucgugauaggcauacuuacauuggcagcaauaauagcagccaaugaaaugggauuguuggaaacuacaaagagagauuuaggaauguccaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagccauagccaaccaggcagugguccugauggguuuggacaaaggauggccaauaucaaaaauggacuuaggaguaccccugcuggcauugggcugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacgcucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacucuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaauauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaacucaacauggcacuaugaugacgaaaaccccuacaaaacgugggcuuaccauggaucuuaugaaguuaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaagagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaagcagaccucgagaacccucaucugccagagaagaaaauugcacaaugguuggagaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaaaauaaaacuccagucacaaccugggaaaauguuccauaucuagggaagagagaagaccaauggugcggaucacuaauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7285 - RNA, 9873 nt, Artificial Sequence
  derived and/or modified CDS sequence (wt) from DENV-3__GU131954__SS-prME
acaucgcuuugucucaugaugauauugccagcagcacuugcuuuccacuugacuucacgagauggagagccgcgcaugauuguggggaagaaugaaagaggaaaaucccuacuuuuuaagacagcuucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcaaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacuuuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaauaauaucaaauuaacgguaguugugggcgauauaauuggggucuuagagcaaggaaaaagaacacuaacaccacaacccauggagcugaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggccuggguaccacacccagacggcgggacccuggcauuuaggaaaacuagagcuggacuucaacuauugugaaggaacaacaguugucaucacagaaaacugugggacaagaggcccaucacugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugagcaaauggcaaauggaaucgcucuggggcucauggcucuuaaacugauaacacaauuugaaacauaccaauuauggacagcauuaaucuccuuaacguguucaaauacaaucuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccauugaaugaaggcgugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaaccuaaugaucacaguugaugaugauggaacaaugagaauaaaagaugaugagacugagaauaucuuaacagugcucuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagauuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagaugguccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucuccaguuaggguuccaaacuauaauuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugcccacacaccuagcucauagaacgagaaacgcucuggacaaucuggugaugcugcauacgucagaacauggcgguaaagccuacaggcaugcgguggaggaacuaccagagacaauggaaacacuccuacucuugggacucaugaucuuguugacagguggaguaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuagggaugacuaaggagccaggugcuguuucuccaaccagcuauuuagauguggacuugcacccagcaucagccuggacauuguacgcuguggccacuacaguaauaacaccaauguugagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcugggauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugccuuuucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugaaguggauagaacagaagccaaagaaggguuaaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguacccauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaaugcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagccauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaaaauacccggaggagcuauguaugcugaugacacagcugguugggacacaagaauaacagaagaugaccugcacaaugaggaaaagaucacacagcaaauggacccugaacacaggcaguuagcaaacgcuauauuuaagcucacauaccaaaacaaaguggucaaaguucaacgaccgacuccaacaggcacgguaauggacaucauaucuaggaaagaccaaagaggcaguggacagguaggaacuuacggucugaacacauucaccaacauggaagcccaguuaaucagacaaauggaaggagaaggugugcugucaaaagcagaccucgagaacccucaucugccagagaagaaaguuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaacugcaugucuggggaaagccuacgcucaaauguggagucucauguauuuucacagaagagaccucagacuagcauccaacgccauauguucagcaguaccaguccacuggguccccacaaguagaacgacaugguccauucaugcucaccaucaguggaugaccacagaagauaugcucacugucuggaacaggguguggaucgaggacaauccauggauggaagacaaaacuccagucacaaccugggaaaacguuccauaucuagggaagagagaagaccaauggugcggaucacuuauuggccucacuuccagagcaaccugggcccagaacauacccacagcaauucaacaggugagaagccuuauaggcaaugaagaguuucuggacuacaugccuucaaugaagagauuuaggaaggaggaggagucggaaggagccauuugguaa

SEQ ID NO: 7286 - RNA, 9873 nt, Artificial Sequence
  derived and/or modified CDS sequence (wt) from DENV-3__GQ868578__SS-prME
acaucgcucugucucaugaugauauugccagcagcacuugcuuuccacuugacuucacgagauggagagccgcgcaugauuguggggaagaaugaaagagguaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaucucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaagguaguuauuuuuauacuacuaaugcuggucaccccauccaugacaaugagaugugugggaguaggaaacagagauuuuguggaaggucuaucaggagcuacgugggucgacguggugcucgagcacggggggugugugaccaccauggcuaagaacaagcccacguuggacauagagcuucagaagaccgaggccacccaacuggcgacccuaaggaagcuaugcauugaggggaaaaucaccaacauaacaaccgacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaucaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuuggguuagaaugcucaccacggacagguuuggacuucaaugaaaugaucuugcuaacaaugaagaacaaagcauggaugguacacagacaaugguucuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacggaaauccaaaacucaggaggcacaagcauuuuugcggggcacuuaaaauguagacuuaagauggacaaauuagaacucaaggggaugaguuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaaugagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaggauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagagaaagcaucccucauagaggugaaaaccugcaaauggccuaaaucacacacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaccagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguucucuucacguuuguacuccuucucucagggcaaauaacauggagagauauggcgcacacacuaauaaugauugggucuaaugcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauuuuuacguugacuguugccuggagaacagccacccugauuuuggccggaguuucgcucuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauccuggccaguucucuccuuagaaaugauguaccuauggcuggaccauuaguggccgggggcuugcugauagcgugcuacgucauaacuggcacgucagcagaccucaccguagaaaaagcagcagauguaacaugggaggaagaggcugagcaaacgggagugucccacaacuuaaugaucacaguugaugaugauggaacaaugagaauaaaagaugaugagacugagaauaucuuaacagugcuucugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaaguuauugccguagagccugggaaaaacccaaagaacuuucaaaccaugccaggcacuuuucagacuacaacaggggaaauaggagcaaucgcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguuuaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaacuugauaauaauggaugaagcccauuucacagacccagccaguauagcugcuagaggguacauaucaacucguguuggaaugggagaagcagcugcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuucuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcagcugguagaaagucaauagcccuugaucuugugacagaaauaggaagagugccuacacacuuagcucauagaacgagaaacgcucuggacaaucuggugaugcugcauacaucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacuugcauaugucgugauaggcauacuuacauuggcagcaauaauagcagccaaugaaaugggauuguuggaaacuacaaagagagauuuaggaauguccaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagccauagccaaccaggcagugguccugauggguuuggacaaaggauggccaauaucaaaaauggacuuaggaguaccccugcuggcauugggcugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacagggccaauaacaacgcucugggaaggaucaccugggaaguuuuggaacaccacgauagcuguuuccauggcgaacauuuuuagagggagcuauuuagcaggagcugggcucgcuuuuucuaucaugaaaucaguuggaacagggaaaagaggaacaggcucacagggugaaacucuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaauauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguauuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaacucaacauggcacuaugaugacgaaaaccccuacaaaacgugggcuuaccauggaucuuaugaaguuaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaagagaaccaaugggacagcgcgaaagcugcuguugaggaugaggauuucuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaagguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaagcagaccucgagaacccucaccugccagagaagaaaauugcacaaugguuggagaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaauggaugaccacagaagacaugcuuacugucuggaacaggguguggaucgaggacaauccauggauggaagauaaaacuccagucacaaccugggaaaauguuccauaucuagggaagagagaagaccaauggugcggaucacuaauaggccucacuuccagagcaaccugggcccagaacauacccacagcaauucaacaggugagaagccuuaugggcaaugaagaguuucuggacuacaugccuucaaugaaaagauuuaggaaggaggaggagucggagggagccauuugguaa

SEQ ID NO: 7287 - RNA, 9873 nt, Artificial Sequence
  derived and/or modified CDS sequence (wt) from DENV-3__FJ898457__SS-prME
acaucgcucugucucaugaugauauugccagcagcacuugcuuuccacuugacuucacgagauggagagccgcgcaugauaguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaacaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggauaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuucuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaaugguggcuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacggcggcaguacucuugcugaucacacauuaugccauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaacaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7288 - RNA, 9873 nt, Artificial Sequence
  derived and/or modified CDS sequence (wt) from DENV-3__KF955505__SS-prME
acaucgcucugucucaugaugauauugccagcagcacuugcuuuccacuugacuucacgaaauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugauucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaaccuauggagcuaaaauacucauggaaaacguggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccauuagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccacuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggccagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugagucuaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcgaugcuuuucuuaauaucugguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccucuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaauuacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccagguuaugcccaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaaaaaacuuggagaguuuggcaaagcaaaagguaguagagcuauaugguacaugugguugggagccagguaccuugaguucgaagcccuuggauuccuaaaugaagaccacugguuuucgcgugagaacucuuacaguggaguggaaggagaaggacugcccaagcuagguuauauauuaagggacauuuccaagauacccggaggagcuauguaugcugaugacacagcugguugggacacaagaauaacagaagaugaccugcacaaugaggaaaagaucccccaccaaauggacccugaacacagccgguuagcgaacgcuauauuuaagcucacauaccaaaacaaaguggucaaaguucaacgaccgacuccaacaggcacgguaauggacaucauaucuaggaaagcccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuaccggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7289 - RNA, 9873 nt, Artificial Sequence
  derived and/or modified CDS sequence (wt) from DENV-3__FJ898464__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacguacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcucuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaaccuauggagcuaaaauacucauggaaaacauggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccauuagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugauaggaugggaaugggcguuaccuaccuagcuuuaauugcaacauuuaaaauccagccauucuuggcuuugggauuuuuucuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacgugcucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccgaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaauaucgcuugaaaggugagucuaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucugguaaagggauuggaaagaccucaauaggacucauuuguguaauugcuuccagcggcauguuguggauggccgagaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacacuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaauggcuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7290 - RNA, 9873 nt, Artificial Sequence
  derived and/or modified CDS sequence (wt) from DENV-3__JQ922556__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaaguugagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggaguaggaaacagagauuuuguggaagggcugucaggagcuacguggguugacguggugcuagagcacggggggugugugaccaccauggcuaagaacaagcccacgcuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacaggucuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaagggaagcucuauugggaagauguucgaggccccugccagaggugcaaggcgcauggccaucuugggagacacagcuugggucuuuggaucaguaggugguguucugaacucauuaggcaaaauggugcaccaaauauucggaagugcuuacacagcccuauucaguggagucucuugggugaugaaaauuggaauagguguccuccugacuuggauaggguugaauucaaaaaacacauccaugucauuuucaugcaucgcgauaggaaucaucacacucuaucugggagcugugguacaagcugacauggggugugucauaaacuggaaaggcaaagaacuuaaauguggaaguggaauuuucgucaccaacgagguccauaccuggacagagcaguacaaauuccaagcggauuccccaaaaagauuggcgacagcuauugcaggcgcuugggagaauggagugugcggaauuaggucaacaaccagaauggagaaucucuuguggaagcaaauagccaaugaacugaacuacauauuaugggaaaacaauaucaaauuaacgguaguugugggcgacacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaagcacaccggaguguccaagugccucaagagcauggaaugugugggagguggaagauuacggguucggagucuucacaaccaacauauggcugaaacuccgagagguguacacccaaaugugugaccauaggcuaaugucgccagcugucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggaguuggacuggcuauggcaacaacguuacaauugccagaggacauugaacaaauggcaaauggaaucgcccuggggcucauggcuuuuaaauugauaacacaauuugaaacauaccaauuauggacggcauuaaucuccuuaacguguucaaauacaauuuucacguugacaguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuggccaguucucuccuuagaaaugacgugcccauggcuggaccauuaguggccgggggcuugcugauagcgugcuacgucggaacuggcacgucagcagaucuuacuguagaacaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguaucuuuccauacuccauacccgcaacauuguuggucuggcauacuuggcaaaagcaaacccaaagauccgguguucuaugggacguacccagccccccagagacacagaaagcagaacuggaagaaggggucuauaggaucaagcagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcccacaauggcaaaagggggaggaggugcagguuauuaccguagagccugggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaccuuccagccauuguuagagaggcaaucaacagacguuuaagaacucuaauuuuggcaccgacaagggugguugcagcugagauggaagaagcauugaaagggcucccaauaagguaccaaacaacagcuacaaaaucugaacacacgggaagagagauuguugaucuaaugugccacgcaacguucacaaugcgccugcugucaccaguuaggguuccaaacuauaacuugauaauaauggaugaggcccauuucacagacccagccaguauagcggccagaggguacauaucaacucguguuggaaugggagaggcagccgcaauuuuuaugacggcaacgcccccuggaacagcugaugccuuuccucagagcaacgcuccaauucaagaugaagaaagggacauaccagaacgcucauggaauucaggcaaugaauggauuaccgacuuugccgggaaaacggugugguuuguccccagcaucaaagccggaaaugacauagcaaacugcuugcgaaagaacgggaaaaaggucauucaacuuaguaggaagacuuuugaaacagaauaucagaagacuaaacuaaaugauugggacuuuguggggacaacugacauuucagaaaugggggccaauuucaaagcagauagagugaucgacccaagaagaugucuaaaaccggggauccugacagauggaccagagggggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaaaggugaauccaggaagacuuucguagaacucaugaggaggggugaccuuccaguuugguuagcccacaaaguagcaucagaagggaucaaauauacagauagaaaauggugcuuugauggacagcgcaacaaucaaauuuuagaggaaaacauggacguggaaaucuggacaaaggaaggagaaaagauaaaauuaagaccuagguggcuugaugcccgcacuuauucagaucccuuagcacucaaggaauucaaggacuuugccgcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacuuaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacuguuggaaacuacaaagagagauuuaggaguguccaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugcgcaguucaacuguuguuaaugagaacaucaugggccuugugugaagcucuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaacuaacacaucaugccgugucgagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuguuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaggccacaggcucaggcuccuccaugauaaauggagucgugaaacuucucacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaagguuagaaccaacgcagccaugggcgccguuuucacagaggagaaccaaugggacagugcgaaagcugcuguugaggaugaagaauuuuggaaacuuguggacagagaacgugaacuccacaaauuaggcaaguguggaagcuguguuuacaacaugaugggcgggagagagaagaaacuuggagaguuuggcaaagcaaaaggcaguagagcuauaugguacaugugguugggagccagguaccuugaguucgaagcccuuggauucuugaaugaagaccacugguucucgcgugaaaacucuuacaguggaguagaaggagaaggacugcacaaacuaggcuacauauuaagggacauuuccaagauacccggaggagccauguaugcugaugacacagcuggcugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaacauggaagcccaguuagucaggcaaauggaaggagaaggugugcugucaaaggcagaccucgagaacccucaucugccagaaaagaaaaucacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagucuuagagaaaccgcauguuuggggaaagccuacgcccaaauguggagucucauguauuuucacagaagagaucucagacuagcguccaaugccauauguucagcaguaccaguccacugggucaccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaagaggaggagucggagggagccauuugguaa

SEQ ID NO: 7291 - RNA, 9873 nt, Artificial Sequence
  derived and/or modified CDS sequence (wt) from DENV-3__JQ922557__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaaguugagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaacgucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcaguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacaggacuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaaaggaagcucuauugggaagauguucgaggccacugccagaggugcaaggcgcauggccaucuugggagacacagcuugggacuuuggaucaguaggugguguucugaacucauuaggcaaaauggugcaccaaauauucggaagugcuuacacagcccuauucaguggagucucuugggugaugaaaauuggaauagguguccuccugacuuggauaggguugaauucaaaaaacacauccaugucauuuucaugcaucgcgauaggaaucaucacacucuaucugggagcugugguacaagcugacauggggugugucauaaacuggaaaggcaaagaacuuaaauguggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcaaauagccaaugaacugaacuacauauuaugggaaaacaauaucaaauuaacgguaguugugggcgacacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggaaaucagacccaucagugagaaagaagagaacaugguaaagucuuuagucucagccgggaaaaguaaaagggacaacuccacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuaauguuaggaguuggacuggcuauggcaacaacguuacaauugccagaggacauugaacaaauggcaaauggaaucgccuuggggcucauggcucuuaaauugauaacacaauuugaaacauaccaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguuggacuugugagcauucuggccaguucucuccuuagaaaugacgugcccauggcuggaccauuaguggccgggggcuugcugauagcgugcuacgucauaacuggcacgucagcagaccucacaguagaaaaagcagcagauguaacaugggaggaagaggcugagcaaacaggagugucccacaacuuauugaucacaguugaugauaauggaacaaugagaauaaaggaugaugagacugagauuauucuaacagugcuuuugaagacagcauuacaaauaguaucggguaucuuuccauacuccauacccgcaacauuguuggucuggcauacuuggcaaaagcaaacccaaagauccgguguuuuaugggacguacccagccccccagagacacagaaagcagaacuggaagaaggggucuauaggaucaagcagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagacuacaacaggggaaauaggagcaauugcacuggauuucaagccuggaaccucagggucuccuaucauaaacagagagggaaagguagugggacuauauggcaauggagugguuacaaaaaauggagacuaccucagcggaauagcgcaaacaaaugcagaaccauacggaccgucaccagauuuggaagaagagauguucaaaaagcgaaaacuaaccauaauggaucuucauccugggucaggccagacuuugaaauaccuuccagccauuguuagagacgcaaucaagagacguuuaagaaucuuaauuuuggcaccgacaagggugguugcagcugagauggaagaagcauugaaagggcucccaauaagguaccaaacaacagcaacaaaaucugaacacacgggaagagagauuguugaucuaaugugccacgcaacguucacaaugcgcuugcugucaccaguuaggguuccaaacuauaacuugauaauaauggaugaggcccauuucacagacccagccaguauagcggccagaggguacauaucaacucguguuggaaugggagaggcagccgcaauuuuuaugacggcaacgcccccuggaacagcugaugccuuuccucagagcaacgcuccaauucaggaugcagaaagggacauaccagaacgcucauggaauucaggcaaugaauggaucaccgacuuugccgggaaaacggugugguuuguccccagcaucaaagccggaaaugacauagcaaacugcuugcgaaagaacgggaaaaaggucauucaacuuaguaggaagacuuuugaaacagaauaucagaagacuaaacuaaaugauugggacuuuguggugacaacugacauuucagaaaugggggccaauuucaaagcagauagagugaucgacccaagaagaugucuaaaaccagugauccugacagauggaccaaagcgggugauccuggcuggaccuaugccagacaccgcggccagugcugcgcaaaggagagggagaguuggcaggaacccacaaaaagaaaaugaccaguacauauucccgggccagccucucaacacugaugaagaccaugcucacuggccugaaacaaaacuguugauggacuuauucaccacuccagagggaaucuuaccgucucacuuugauccacauggggagaauuuucccgaaauauccggugaauaucgccugaaaggugaauccaggaagacuuucguagaacucaugaggaggggugaccuuccaguuugguuagcccacaaaguagcaucagaagggaucaaauauacagauagaaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaauuccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcggccaaugaaaugggacuguuggaaacuacaaagagagauuuaggaaugucuaaggagccagguguuguuucuccaacuagcuauuuggauguggacucacacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugcgcaguucaacuguuguuaaugagaacaucaugggccuugugugaagcucuaacuuuagcuacaggaccaaugacaacacucugggaaggaucgccugggaagauuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauugucccggaaagaguuugaccuuuacaagaagucuggaaucacugaaguggauagaacagaagccaaagaaggguugaaaagaggagaaacaacacaucaugccgugucgagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaaugcacuggauaucuaaugguacagguaacauugucucuucagucaacaugguauccagauuguuacugaacagguucacgaugacacacaggagacccaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaauccuuacaaaacgugggcuuaccauggauccuaugaagucaaagccacaggcucagccuccuccaugauaaauggagucgugaaacuccucacuaaaccaugggauguggugcccauggugacacagauggcaaugacagauacaaccccauuuggccagcagagaguuuuuaaagagaaaguggacaccaggacacccaggcccaugccagggacaagaaagguuauggagaucacagcggaguggcucuggagaacccugggaaggaacaaaagacccagauuaugcacaagggaagaguuuacaaaaaagguuagaaccaacgcagccaugggcgccguuuucacagaggagaaccaaugggacagugcgaaagcugcuguugaggaugaagaauuuuggaaacuuguggacagagaacgugaacuccacaaauuaggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuugaaugaagaccacugguucucgcgugaaaacucuuacaguggaguagaaggagaaggacugcacaaacuaggcuacauauuaagggacauuuccaagauacccggaggagccauguaugcugaugacacagcugggugggacacaagaauaacagaagaugaccugcacaaugaggaaaagaucacacagcaaauggacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauuuaccaacauggaagcccaguuagucaggcaaauggaaggagaaggugugcugucaaaggcagaccucgagaacccucaucugccagaaaagaaaaucacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagucuuagagaaaccgccuguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugacuacagaagacaugcuuacuguuuggaacaggguguggaucgaggacaauccauggauggaagacaaaacuccaguuacaaccugggaaaacccuccauacuuagggaagagagaagaccaauggugcggaucaauuauuggucuaucuuccagagcaaccugggcccagaacauacccacagcaauucaacaggugagaagccuuauaggcaaugaagaguuucuggacuacaugccuucaaugaagagauucaggaaagaggaggagucggagggagccauuugguaa

SEQ ID NO: 7292 - RNA, 9873 nt, Artificial Sequence
  derived and/or modified CDS sequence (wt) from DENV-3__JQ922555__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucgacaugggugacuuauggaacgugcaaucaagcuggagagcauagacgcgauaagagaucaguggcguuagcuccccaugucggcaugggacuggauacacgcacccaaaccuggaugucggcugaaggagcuuggagacaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggugggugugugacuaccauggcuaagaacaagcccacgcuggauauagagcuucagaagaccgaggccacccaacuggcgacccuaaggaagcuaugcauugagggaaaaauuaccaacauaacaacugacucaagguguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugucuagaaucaauagagggaaaaguggugcaauaugagaaccucaaauacaccgucaucauuacagugcacacaggagaccaacaccaggugggaaaugaaacgcagggagucacggcugagauaacaccccaggcaucaaccgcugaagccaucuugcccgaauauggaacccuugggcuagaaugcucaccacggacagguuuggauuucaaugagaugaucuuacugacaaugaagaacaaagcauggaugggacauagacaaaugcucuucgaccuccccacaccauggacaucaggaacuacaacagaaacaucagccuggaacaggaaagaaccuuuugugacauucaaaaacgcacauacaaaaaaacaagaagugguuguccuuggaucgcaagagggagcuaugcauacagcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucguuaaggucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaaagccuugaaaaucaacugguacaggaagggaagcucgauugggaagauguuugaggccacuuccagaggugcaaggcgcauggccaucuugggagacacagccugggacuuuggaucagugggugguguucugaacucauugggcaaaauggugcaccaaauauuuggaagugcuuacacagcccuauuuaguggagucucuuggguaaugaaaauuggaauagguguccucuuaacuuggauaggguugaauucaaaaaacacauccaugucauuuucauguauugcgauaggaaucauuacacucuaucugggagccgugguacaagcugacauggggugugucauaaacuggaaaggcaaagaacucaaauguggaaguggaauuuucgucaccaacgagguccauaccuggacagagcaauacaaauuucaagcagacuccccaaaaagacuggcgacagccauugcaggcgcuugggagaauggaguaugcggaauuaggucaacaaccagaauggagaaucucuuguggaagcaaauagccaaugaacugaacuacauauuaugggaaaacaauaucaaauuaacgguaguugugggcgacacaauuggggucuuagagcaagggaaaagaacacuaacaccacaacccauggagcuaaaauauucauggaaaacguggggaaaggcaaaaauagugacagcugaaacacaaaauuccucuuucauaauagaugggccaaacacaccggaguguccaagugccucaagagcauggaaugugugggagguggaagauuacggguucggagucuucacaaccaauauauggcugaaacuccgagagguguacacccaaauaugugaccauaggcuaaugucggcagccgucaaggaugagagggccguacaugccgacaugggcuauuggauagaaagccaaaagaauggaaguuggaagcuagaaaaagcaucccucauagaggugaaaaccagcacauggccaaaaucacacacucuuuggaguaauggugugcaagagagugacaugaucaucccaaagagucuagcugguccuauuucgcaacacaacuacaggcccggguaccacacccaaacggcaggacccuggcacuuaggaaaauuggagcuggauuucaacuauugugaaggaacaacaguugucaucacagaaaacugugggacaagaggcccaucauugagaacaacaacagugucagggaaguugauacacgagugguguugccgcucgugcacacuuccuccccugcgauauaugggagaagacggcugcugguauggcauggaaauuagacccaucagugagaaagaagagaacaugguaaagucuuuagccucagcaggaaguggaaagguggacaacuucacaauggguguccuguguuuggcaauccucuuugaagaggugaugagaggaaaauuugggaagaaacacaugauugcagggguucucuucacguuugugcuccuucucucagggcaaauaacauggagagacauggcgcgcacacucauaaugauuggguccaacgccucugacaggaugggaaugggagucacuuaccuagcuuuaauugcaacauuuaaaauccagccauucuuggcuuuaggauucuuccugaggaaacugacaucuagagaaaauuuauuguugggaguuggguuggcuauggcaacaacguuacaacugccagaggacauugaacaaauggcaaauggaaucgcucuggggcucauggcucuuaaacugauaacacaauuugaaacauaucaauuauggacggcauuagucucccuaacguguucaaauacaauuuuuacguugacuguugccuggagaacagccacccuaauuuuggccggaguuucgcuuuugccagugugccagucuucgagcaugaggaaaacagauuggcucccaaugacuguggcagcuaugggaguuccaccccuaccacuuuuuauuuuuagcuugaaagauacacucaaaaggagaagcuggccacuaaaugagggggugauggcuguugggcucgugagcauucuagccaguucucuccuuaggaauggugugcccauggcuggaccacuaguggccgggggcuugcuuauagcguguuacgucauaacuggcacgucagcagaccucacuguagaaaaagcagcagauguaacaugggaggaagaggcugagcaaacaggagugucccacaauuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcauacuuggcaaaagcaaacccaaagauccggcguuuuaugggacguacccagccccccagagacacagaaagcagaacuggaagaaggggucuauaggaucaaacagcaaggaauuuuugggaaaacccaaguggggguuggaguacagaaagaaggagucuuccacaccauguggcacgucacaagaggggcaguguugacacauaaugggaaaagacuggaaccaaacugggcuagcgugaaaaaagaucugauuucauacggaggaggauggagauugagugcacaauggcaaaagggagaggaggugcagguuauugccguagagccugggaagaacccaaagaacuuucaaaccaugccgggcacuuuucagacuacaucaggggaaauaggagcaauugcacuggauuuuaagccuggaacuucaggaucuccuaucauaaauagagagggaaagguagugggacuguauggcaauggagugguuacaaagaaugguggcuacgucagcggaauagcgcaaacaaaugcagaaccagacggaccgacaccagaguuggaagaagagauguucaaaaagcgaaaucuaaccauaauggaucuucauccugggucaggaaagacgcggaaauaccuuccagcuauuguuagagaggcaaucaagagacgcuuaagaacucuaauuuuggcaccgacaagggugguugcagcugagauggaagaagcauugaaagggcucccaauaagguaccaaacaacugcaacaaaaucugaacacacaggaagagagauuguugaccuaaugugccacgcaacguucacaaugcgcuugcugucaccaguuaggguuccaaauuacaacuugauaauaauggaugaggcccauuucacagacccagccaguauagcggcuagaggguacauaucaacucguguaggaaugggagaggcagccgcaauuuucaugacagcaacacccccuggaacagcugaugccuuuccucagagcaacgcuccaauucaagaugaagaaagggacauaccagaacgcucauggaauucaggcaaugaauggauuaccgacuuugcugggaagacggugugguuugucccuagcauuaaagccggaaaugacauagcaaacuguuugcgaaaaaacgggaaaaaggucauucaacuuaguaggaagaccuuugacacagaauaucaaaagacuaaauugaaugauugggacuucguggugacaacugacauuucagaaaugggagccaauuucaaagcagauagagugaucgacccaagaagaugucucaaaccagugauuuugacagauggacccgagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaugcaaaaaugcugcuggagaacaucaacacaccagaagggauuauaccagcucucuuugaaccagaaagggagaagucggccgguuuagacggugaauaccgccugaagggugaguccaggaagacuuucguggaacucaugaggaggggugaccucccaguuugguuagcccauaaaguagcaucagaagggaucuuauacacagauaggaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggauuuugcagcuggcagaaagucaaucgcccuugaucuugugacagaaauaggaagagugucuucacacuuagcccacagaacgagaaacgcucuggacaacaaaaugaugcugcacacgucagaauauggcggaagggccuacaggcaugcaguggaggaacuaccagaaacaauggaaacacuccuacucuugggacucaugaucuuguugacagguggagcaaugcuuuucuugauaucagguaaagggauuggaaagacuucaauaggacucauuuguguaauugcuuccagcgguauguuauggauggccgaugucccacuccaauggaucgcgucggcuauaguccuggaguuuuuuaugaugguguugcuuauaccagaaccagaaaagcagagaacuccccaagacaaccaacucgcauaugucgugauaggcauacuuacauuggcugcaauaauagcggccaaugaaaugggacuguuggaaacuacaaagagagauuuaggaguguccaaggagccagguguuguuucuccaacuagcuauuuggauguggacuugcacccagcaucagccuggacauuguacgccguggccacaacaguaauagcaccaauguugagacauaccauagagaauuccacagcaaaugugucaauggcagcuauagcuaaccaggcagugguccugauggguuuggacaaaggauggccaauaucgaaaauggacuuaggcguaccacuacuggcauuggguugcuauuuuuacgugaacccacugacucuuacagcggcaguauuuuugcuagucacacauuaugcuauuauagguccaggauugcaggcaaaagccacucgugaagcucauaaaaagacagcugcuggaauaaugaauccuccaccgggggaugggauaaugacaauagaccuagauccuguaauauaugauucaaaauuugaaaagcaacugggacagguuaugcuccugguucugugugcaguucaacuuuuguuaaugagaacaucaugggccuugugugaagccuuaacccuagccacaggaccaacaacaacacucugggaaggaucaccugggaaguuuuggaacaccacgauagcuguuucuauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaauccggaaucacugaaguggauagaacagaagccaaagaaggguugaaaagaggagaaauaacacaucaugcuguguccagagguagcgcaaaacuucaaugguucguggagagaaacauggucauucccgaaggaagagucauagacuuaggcuguggaaaaggaggcuggucauauuacugugcaggacugaaaaaaguuacagaagugcgaggauacacaaaaggcggcccaggacacgaagaaccaguaccuaugucuacauauggauggaacauaguuaaguuaaugaguggaaaggauguguuuuaucuuccaccugaaaagugugauacccuauugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagacuacaaaggaaacauggaggaaugcuugugaggaauccacucucacgaaacuccaggaacgaaauguacuggauauccaaugguacaggcaacaucgucucuucaguuaacaugguauccagauugcuacugaacagauucacgaugacacacaggagacccaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaauccuuacaaaacgugggcuuaccauggauccuaugaagucaaagccacaggcucagccuccuccaugauaaauggagucgugaaacuccucacuaaaccaugggauguggugcccauggugacacagauggcaaugacagauacaaccccauuuggccagcagagaguuuuuaaagagaaaguggacaccaggacacccaggcucaugcccaggacaagaaagguaauggagaucacagcggaguggcucuggagaacccugggaaggaacaaaagacccagauuaugcacaagggaagaguucacaaaaaaggucagacccaucgcagccaugggcgccguuuucacacagagagaccaaugggacagugcgaaagcugcuguugaggaugaagaauuuuggaaaccuguggacagagaguguaacucccaccaauugggcaaauguggaagcugcguuuacaacaugaugggcaagagagagaagaaacuuggagaguuuggcaaagcaaaaggcaguagagcuauaugguacaugugguugggagccagguaccuugaguucgaagcccucggauucuuaaaugaagaccacugguucucgcgugaaaacucuuacaguggaguagaaggagaaggacugcacaagcugggauacauauuaagggacauuuccaagauacccggaggagcuauguaugcugaugacacagcugguugggacacaaggaauacagaagaugaccugcacaugaaggaaaagaucacacagcaaaugggaccuggacacagcagguuagcgaacgcuauauucaagcucacauaccaaaacaagguggucaaaguucaacgaccaacuccaacgggcacgguaauggacaucauaucuaggaaagaccaaagaggcaguggacaggugggaacuuauggucuaaauacauucaccaacauggaagcccaguuagucagacaaauggaaggagaaggugugcugucaaaggcagaccucgagaacccucaucugcuagagaagaaaauuacacaaugguuggaaaccaaaggaguggagagguuaaaaagaauggccaucagcggagaugauugcguagugaaaccaaucgaugacagguucgcuaaugcccugcuugcucugaacgauaugggaaagguuaggaaggacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcgagaaucucucaaggagcaggauggagccuuagagaaacugcaugucuggggaaagccuacgcccaaauguggagucucauguauuuucacagaagagaucucagacuagcauccaacgccauauguucagcaguaccaguccauuggguccccacaaguagaacgacauggucuauucaugcucaccaucaguggaugacuacagaagacaugcuuacugucuggaacaggguguggauagaggauaauccauggauggaagacaaaacuccaguuacaacuugggaaaauguuccauaucuagggaagagagaagaccaauggugcggaucacucauuggucucacuuccagagcaaccugggcccagaacauacccacagcaauccaacaggugagaagccuuauaggcaaugaagaguuucuggacuacaugccuucgaugaagagauucaggaaggaggaggagucagagggagccauuugguaa

SEQ ID NO: 7293 - RNA, 9873 nt, Artificial Sequence
  derived and/or modified CDS sequence (wt) from DENV-3__GU131903__SS-prME
acaucgcucugucucaugaugauguuaccagcaacacuugcuuuccacuugacuucacgcgauggagagccgcgaaugauuguggggaagaaugaaagagggaaauccuuacuauuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagccacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguugggggaacgguugugguuuguuuggaaaaggaagcuuggugacaugcgcgaaauuucaaugucuagaaccaauagagggaaaaguggugcaacaugagaaccuuaaauacacugucaucaucacagugcacacaggagaccaacaccaggugggaaacgacacgcagggagucacgguugagauaacaccccaggcuucaaccguugaagcugucuugccugaguauggaacccuugggcuagaaugcucaccacggacaggccuggauuucaaugaaaugauuuuguugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcagggcacuugaaauguagacuuaagauggacaaacuggaacucaaggggaugagcuaugcaaugugcuugaauaccuuuguguugaagaaagaagucucugaaacgcagcaugggacaauacucauuaagguugaguacaaaggggaagacgcaccuugcaagauuccuuucuccacagaggauggacaagggaaagcccacagugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaaucaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauacucauggaaaacauggggaaaggcaaaaauagugacagcugaaacacaaaauuccucuuucauaauagaugggccaaacacaccggaguguccaaaugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccugcacuuggccaaaaucacacacucuuuggagcaaugguguacuagagagugacaugaucaucccaaagagucuagcugguccuauuucacaacacaaccacaggcccggguaccacacccagacggcaggaccuuggcacuugggaaaacuggagcuggacuuuaauuauugugaaggaacaacaguagucaucacagaaaacugugggacaagaggcccaucauugagaacaacaacagugucagggaagcugauacacgaaugguguugccgcucgugcacacuuccucccuugcgauacaugggagaggauggcugcugguauggcauggaaauuagaccuaucaaugagaaagaagagaacaugguaaagucucuagucucagcagggaguggaaagguggacaacuucacaaugggaguccuguguuuagcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgauaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagccaguucucuccuuaggaaugaugugcccauggcuggaccacuaguggccggggguuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaggaggugcagguuauugccguagagccugggaagaacccaaaaaacuuucaaaccaugccaggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauuuacaaugcgcuuacuaucgccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaauacaccagaagggaucauaccagcucucuuugaaccagagagggagaagucagccgcuauagacggugaauaccgccugaagggugaguccaggaagaccuucguggaacucaugaggaggggugaccucccaguuuggcuagcucauaaaguagccucagaagggaucaaauacacagauagaaaauggugcuuugauggagaacgcaauaaucaaauuuuagaggagaacauggauguggaaaucuggacaaaggaaggagaaaggaaaaaacugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaauguccaaagaaccagguguuguuucuccaaccagcuauuuagauguagacuugcacccagcaucagccuggacauuguaugccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccaucauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagccgggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaagccggcccaggccacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacauggcaacugggauugagcaccuagaaagacuacaaagaaaauauggaggaaugcuugugagaaacccacucucacgaaacuccacgcaugaaauggacuggauauccaauggcaccggcaacaucgucucuucagucaacaugguaucuagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagugaaagccacaggcucagccuccuccaugauaaauggagucgugaaacuccucacaaaaccaugggaugugguucccauggugacacagauggcaaugacagacacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagccgcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggauccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagccgaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuucuagagcaaccugggcccagaacauacucacagcaauccaacaggugagaagccucauaggcgaugaagaauuucuggacuacaugccuucgaugaagagauucaggaaggaggaggagucagagggagccauuugguaa

SEQ ID NO: 7294 - RNA, 9873 nt, Artificial Sequence
  derived and/or modified CDS sequence (wt) from DENV-3__GU131904__SS-prME
acaucgcucugucuuaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuauauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucauuacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggaggcacaagcauuuuugcggggcacuugaaauguagacuuaagauggacaaacuggaacucaaggggaugagcuaugcaaugugcuugaauaccuuuguguugaagaaagaagucuccgaaacacagcaugggacaauacucauuaaaguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgccugggaaaauggagucuguggaaucaggucaacaaccagaauggagaaucuauuguggaagcaaauagccaaugagcugaacuacauauuaugggaaaacagcaucaaauuaacgguaguugugggcgacauaauuggggucuuagagcaagggaaaagaacacuaacaccacagcccauggagcugaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccgaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugaucggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacguugacuguugccuggagaacagccaccuugauucuggccggaguuucgcuguugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuggcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaauagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagacgaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgccauagacggugaauaccgccugaagggugaguccaggaagaccuucguggaacucaugaggaggggugaccucccaguuuggcuagcccacaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaccccuuagcacucaaggaauucaaggauuuugcagcuggcagaaagucaaucgcccuugaucuuguaacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauugcuuccaguggcauguuauggauggcugaugucccacuccaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacgaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaaaaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugagaaaaguuacagaagugcgaggauacacaaaaggcggcccaggacacgaagaaccaguaccuauguccacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccguggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacaaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuacgaugaugaaaauccuuacaaaacgugggcuuaccauggauccuaugaagucaaagccacaggcucagccuccuccaugauaaauggagucgugaaacuccucacaaaaccaugggaugugguuccuauggugacacagauggcaaugacagauacaacuccauuugggcagcaaagaguuuucaaagagaaaguggacaccaggacacccaggcccauggcagggacaagaaagguuauggagauuacagcggaauggcuuuggagaacccugggaaggaacaaaaaacccagauugugcacaagggaagaguucacaaaaaaggucagaaccaacgcggccaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguuaggagccagguaccuugaguucgaagcacucggauuuuuaaaugaagaccacugguucucacgugaaaacucuuacaguggaguagaaggagaaggacugcacaagcugggauacauuuuaagagacauuucuaagauacccggaggagccauguaugcugaugacacagcuggcugggacacaagaauaacagaggaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagagguaguggacagguggggacuuauggucugaacacauucaccaacauggaagcccaguuagucagacagauggaaggagaaggcguguugucgaaggcagaccucgagaacccucaucugcuagagaagaaaaucacgcaaugguuggaaaccaaaggaguggagagauuaaaaagaauggccaucagcggggaugauugcguggugaaaccaaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcucacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7295 - RNA, 9873 nt, Artificial Sequence
  derived and/or modified CDS sequence (wt) from DENV-3__GU131906__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugaccuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuaucuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacugccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauuuuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacauugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccagaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagaccccgccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugaggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacaucuagcccacagaacgagaaacgcccuggacaacuuggugaugcugcauacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauugcuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuucuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaauaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauucgggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggggccagguaccuugaguucgaagcacucggauuuuuaaaugaagaccacugguucucgcgugaaaacucuuacagugggguagaaggagaaggacugcacaaguugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagggaagaaaaucacacaaugguuggaaaccaaaggaguggagagauuaaaaagaauggccaucagcggggaugauugcguggugaaaccgaucgaugacagguuugccaaugccuugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggauccccacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuaggaaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauuuaggaaggaggaggagucagagggagccauuugguaa

SEQ ID NO: 7296 - RNA, 9873 nt, Artificial Sequence
  derived and/or modified CDS sequence (wt) from DENV-3__GU131907__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugaaaaccucaaauacacugucaucaucacagugcacacaggagaccaacaccaggugggaaaugacacgcagggagucacaguugagauaacaccccaggcaucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaacugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguuucaggcaucuuuccauacuccauacccgccacacuguuggucuggcacacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguggugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggaaaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccugggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccaugguuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7297 - RNA, 9873 nt, Artificial Sequence
  derived and/or modified CDS sequence (wt) from DENV-3__GQ868634__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcaucgagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagauaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacggauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaccugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7298 - RNA, 9873 nt, Artificial Sequence
  derived and/or modified CDS sequence (wt) from DENV-3__GU131908__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcaucgagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacacuuggacagagcaauacaaauuucaagcagacucccccaaaagacuggcgacagccaucgcaggcgcuuggaaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagauaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacggauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7299 - RNA, 9873 nt, Artificial Sequence
  derived and/or modified CDS sequence (wt) from DENV-3__GU131909__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcuuuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcaucgagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagauaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacggauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaccugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7300 - RNA, 9873 nt, Artificial Sequence
  derived and/or modified CDS sequence (wt) from DENV-3__GU131912__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagcugucuugcccgaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaaacauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccuaucaacauugaggcugaaccuccuuuuggggaaagcaacauagugauuggaauuggagacaaagccuugaaaauuaacugguacaagaagggaagcucgauugggaagauguucgaggcgacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaggcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcucuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucucuuuaacauguucaaacacaauuuucacguugacuguugccuggagaacagccacguugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaagagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacgacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccaacaccggaauuggaagaagaaauguucaaaaagcgaaaucuaacuauaauggaucuucauccugggucaggaaagacgcggaaauaucuuccagcuaucgucagagaggcaaucaagagacgccuaagaacucuaauuuuggcaccaacaagagugguugcagcugagauggaagaagcacugaaaggacucccaauaagguaucaaacaacugcaucaaaaucugaacacacaggaagggagauuguugaucuaaugugccacgcaacauucacaaugcgcuuacuaucaccagucaggguuccaaauuauaauuugauaauaauggaugaggcccauuucacagacccagccaguauagcggcuagaggguauauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcaagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggccgcgauaguagcagcuaaugaaaugggauuauuggaaaccacaaagagagaucuaggaaugucuaaagaaccagguguuguuucuccaaccagcuauuuagauguagacuugcacccagcaucagccuggacauuguacgccguggccacaacagugauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaaucuacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagagaaguggaaaaagaaauuaaaucaguugucccggaaagaguuugaccuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcuggacugaaaaaaguuacagaagugcgaggguacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaggaugguugagccauggcuaagaaacaaccaguuuugcauuaaaguauuaaacccuuacaugccaaaugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggaucugggagcgggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauucaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucggaggcagaccucgagaacccucaucugcuagagaagaaaaucacacaaugguuggaaaccaaaggaguggagagauuaaaaagaauggcuaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcucagaacauacucacagcaauucaacaggugagaagccuuauaggcgaugaagaauuccuggacuacaugccuucgaugaagagauucaggaaggaggaggagucagagggagccauuugguaa

SEQ ID NO: 7301 - RNA, 9873 nt, Artificial Sequence
  derived and/or modified CDS sequence (wt) from DENV-3__GU131913__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcaccucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcagggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccuaucaacauugaggcugaaccuccuuuuggggaaagcaacauagugauuggaauuggagacaaagccuugaaaauuaacugguacaagaagggaagcucgauugggaagauguucgaggcuacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauugucacacucuaucugggagccgugguacaggcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagcuaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagaggugcacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugauaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaauugccagaggacauugaacaaauggcgaauggaauugcucuggggcucaugacucuaaaacugauaacacaauuugagacauaucaguuguggacggcauuagucucuuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaagagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacgacaacgggggaaauaggagcaauugcacuagacuucaagccuggaacuucaggaucuccuaucauaaacagagagggaaagguaguggggcuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaagguuauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguauauauucacgggccagccucucaacaaugacgaagaccaugcccacuggacagaagcaaaaaugcugcuagacaacauuaacacaccagaagggaucauaccagcucucuuugaaccagagagagagaagucagccgcuauagacggugaauaccgccugaagggcgaguccaggaagaccuucguggaacucaugaggaggggugaccucccaguuuggcuagcccauaaaguagccucagaagggaucaaauacacagauagaaaauggugcuuugauggagaacgaaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggugguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaucaacucgcauaugucgugauaggcauacuuacacuggcugcgauaguagcagcuaaugaaaugggauuauuggaaaccacaaagagagaucuaggaaugucuaaagaaccagguguuguuucuccaaccagcuauuuagauguagacuugcacccagcaucagcuuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaaucuacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggguacacaaaaggcggcccaggacacgaagaaccaguaccuaugucuacauacggauggaacauagucaaguuaaugaguggaaaggauguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaaauguaauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggaucugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaaggucauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguuccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggccugaacacauucaccaacauggaagcccaguuagucagacagauggaaggagaaggcguguugucggaggcagaccucgagaacccucaucugcuagagaagaaaaucacacaaugguuggaaaccaaaggaguggagagauuaaaaagaauggccaucagcggggaugauugcgugguaaaaccgaucgaugacagguuugcuaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacagcaugucuagggaaagcuuacgcucaaauguggagucucauguauuuucacagaagagaucuuagacuagcauccaacgccauuuguucagcaguaccaguccauuggaucccuacaagcagaacgacauggucuauucaugcucaccaucaguggaugaccacagaagacaugcuuacugucuggaacaggguguggauagaggacaauccauggaugggagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuccuggacuacaugccuucgaugaagagauucaggaaggaggaggagucagagggagccauuugguaa

SEQ ID NO: 7302 - RNA, 9873 nt, Artificial Sequence
  derived and/or modified CDS sequence (wt) from DENV-3__GU131914__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcaccucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcagggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccuaucaacauugaggcugaaccuccuuuuggggaaagcaacauagugauuggaauuggagacaaagccuugaaaauuaacugguacaagaagggaagcucgauugggaagauguucgaggcuacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaggcugacauggggugcgucauaaacuggaaaggaaaagaacucaaauguggaaauggaauuuuugucaccaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagcuaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagaggugcacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugauaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaauugccagaggacauugaacaaauggcgaauggaauugcucuggggcucaugacucuaaaacugauaacacaauuugagacauaucaguuguggacggcauuagucucuuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaagagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacgacaacgggggaaauaggagcaauugcacuagacuucaagccuggaacuucaggaucuccuaucauaaacagagagggaaagguaguggggcuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaagguuauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagagagaagucagccgcuauagacggugaauaccgccugaagggcgaguccaggaagaccuucguggaacucaugaggaggggugaccucccaguuuggcuagcccauaaaguagccucagaagggaucaaauacacagauagaaaauggugcuuugauggagaacgaaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggugguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaucaacucgcauaugucgugauaggcauacuuacacuggcugcgauaguagcagcuaaugaaaugggauuauuggaaaccacaaagagagaucuaggaaugucuaaagaaccagguguuguuucuccaaccagcuauuuagauguagacuugcacccagcaucagcuuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccaucauagguccaggauugcaggcuaaagccacucgugaagcucaaaaaagaacagcugcuggaauaaugaagaauccaacgguggacgggauaaugacaauagaccuagauccuguaaucuacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggguacacaaaaggcggcccaggacacgaagaaccaguaccuaugucuacauacggauggaacauagucaaguuaaugaguggaaaggauguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaaauguaauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggaucugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaaggucauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguuccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggccugaacacauucaccaacauggaagcccaguuagucagacagauggaaggagaaggcguguugucggaggcagaccucgagaacccucaucugcuagagaagaaaaucacacaaugguuggaaaccaaaggaguggagagauuaaaaagaauggccaucagcggggaugauugcgugguaaaaccgaucgaugacagguuugcuaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacagcaugucuagggaaagcuuacgcucaaauguggagucucauguauuuucacagaagagaucuuagacuagcauccaacgccauuuguucagcaguaccaguccauuggaucccuacaagcagaacgacauggucuauucaugcucaccaucaguggaugaccacagaagacaugcuuacugucuggaacaggguguggauagaggacaauccauggaugggagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuccuggacuacaugccuucgaugaagagauucaggaaggaggaggagucagagggagccauuugguaa

SEQ ID NO: 7303 - RNA, 9873 nt, Artificial Sequence
  derived and/or modified CDS sequence (wt) from DENV-3__GU131915__SS-prME
acaucgcucugucucaugaugauguuaccagcaacacuugcuuuccacuugacuucacgcgauggagagccgcgaaugauuguggggaagaaugaaagagggaaauccuuacuuuuuaagacagcuucuggaaucaacaugugcacucucauagcuauggacuugggagagaugugugaugacacggucacuuauaaaugcccccucauugcugaagcggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaauguugguuacuccauccaugacaaugagaugcgugggaguaggaaacagagauuuuguggaaggucugucaggagccacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccuuaaauacacugucaucaucacagugcacacaggagaccaacaccaggugggaaacgacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcagggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagacgcaccuugcaagauuccuuucuccacagaggauggacaagggaaagcccacagugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaaucaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagcugguccuauuucacaacacaaccacaggcccggguaccacacccagacggcaggaccuuggcacuugggaaaacuggagcuggacuuuaauuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuagcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgauaggaugggaaugggcguuaccuauuuagcuuuaauugcaacauucaaaauccaaccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgaguaugaggaaaacagauuggcuuccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaggaggugcagguuauugccguagagccugggaagaacccaaaaaacuuucaaaccaugccaggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucgccagucaggguuccaaauuacaauuugguaauaauggacgaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagcuggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccauuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcucauaaaguagccucagaagggaucaaauacacagauagaaaauggugcuuugauggagaacgcaacaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuugacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaauguccaaagaaccagguguuguuucuccaaccagcuauuuagauguagacuugcacccagcaucagccuggacauuguaugccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccaucauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacuacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaauggcaccggcaacaucgucucuucagucaacaugguaucuagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagugaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagccgcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggauccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaaugguguggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7304 - RNA, 9873 nt, Artificial Sequence
  derived and/or modified CDS sequence (wt) from DENV-3__GU131916__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuauggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaucacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuccucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauucgagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaagaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcuccuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcaggucauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugauuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugcuugcggaaaaaugggaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuacuaacaaguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuagcugcgauaguagcagcuaaugaaaugggauuauuggaaacuacaaagagagaucuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccucuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacaguggacgggauaaugacaauagaccuagauccuguaauauacgauucaaaauucgaaaagcaacuaggacaggucaugcucuugguucugugugcaguucaacuuuuguuaaugagaacaucaugggccuugugcgaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucaacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagagaagaguuuacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccuacauaaugaggaaaaaaucacacagcaaauggacccugaacacagacaauuagcgaacgccauauuuaagcucacauaccaaaacaagguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaagacguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuccaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuuucggacuacaugccuucgaugaagagauucaggaaggaggaggagucagagggagccauuugguaa

SEQ ID NO: 7305 - RNA, 9873 nt, Artificial Sequence
  derived and/or modified CDS sequence (wt) from DENV-3__GU131917__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccagaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuacacuacuaaugcuggucacuccauccaugacaaugagaugcgugggaguaggaaacagagauuuuguggaaggucugucaggagcuacguggguugauguggugcucgagcacggugggugcgugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggacagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccaccgccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagcugugguacaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcaccugggaaaauuggagcuggacuuuaacuauugugaaggaacaacaguagucaucgcagaaaacugugggacaagaggcccaucauugagaacaacaacaguaucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaguugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguaccuagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggagcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccccucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacaucagaacauggcgguagggccuacaggcaugcaguagaggaacuaccagaaacaauggaaacacuccuacucuugggacucaugauuuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuuuaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaauuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaagagaggaacggggucacaaggcgaaaccuuaggagagaaguggaaaaagaaauuaaaucaguuaucccggaaagaguuugaccuuuacaagaaaucuggaaucacugaaguggauagaucagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagagucuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaauaugaugggcaagagagagaaaaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuuccaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucauacaaugguuggaaaccaaaggaguggagagauuaaaaagaauggccaucagcggggaugauugcguggugaaaccgaucgaugacagguuugccaaugcccugcuugccuugaacgacaugggaaaggucaggaaggacauaccccaauggcagccaucaaagggguggcaugauuggcaacaggucccuuucugcucccaccacuuucaugaacugaucaugaaagauggaagaaagcuggugguucccugcagaccccaggacgaacuaauaggaagggcgagaaucucucaaggagcaggauggagccuuaaagaaacugcaugccuagggaaagcuuacgcucaaauguggagucucauguauuuucacaggagagaucuuagacuagcauccaacgccauuuguucagcaguaccaguccauuggaucccuacaagcagaacgacauggucuauucacgcucaccaucaguggaugacuacagaagacaugcuuucugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7306 - RNA, 9873 nt, Artificial Sequence
  derived and/or modified CDS sequence (wt) from DENV-3__GU131918__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccagaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugcgugaccaccauggcuaagagcaagccuacgcuggacauagagcuucagaagacugaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggacagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcacccugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccaccgccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguucucuuaaccuggauaggguugaauucaaaaaacacuuccaugucauuuucaugcauugugauaggaauuaucacacucuaucugggagccguggugcaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacaguaucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuggcuaguucucuccuuaggaaugaugugccuauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguaccuagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccccucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaucagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagagucuucaaagagaaaguggacaccaggacacccaggcccaugccagggacaagaaagguuauggagauuacagcggaauggcuuuggagaacccugggaaggaacaaaaaacccagacugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaauaugaugggcaagagagagaaaaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucauacaaugguuggaaaccaaaggaguggagagauuaaaaagaauggccaucagcggggaugauugcguggugaaaccgaucgaugacagguuugccaaugcccugcuugccuugaacgacaugggaaaggucaggaaggacauaccccaauggcagccaucaaagggguggcaugauuggcaacaggucccuuucugcucccaccacuuucaugaacugaucaugaaagauggaagaaagcuggugguucccugcagaccccaggacgaacuaauaggaagggcgagaaucucucaaggagcaggauggagccuuaaagaaacugcaugccuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuucugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7307 - RNA, 9873 nt, Artificial Sequence
  derived and/or modified CDS sequence (wt) from DENV-3__GU131933__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuauauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggcuacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucauuacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggaggcacaagcauuuuugcggggcacuugaaauguagacuuaagauggacaaacuggaacucaaggggaugagcuaugcaaugugcuugaauaccuuuguguugaagaaagaagucuccgaaacacagcaugggacaauacucauuaaaguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacagcaucaaauuaacgguaguugugggcgacauaauuggggucuuagagcaagggaaaagaacacuaacaccacagcccauggagcugaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaaacuagaaaaagcauccuucauagaggugaaaaccuguacuuggccgaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugaucggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacguugacuguugccuggagaacagccaccuugauucuggccggaguuucgcuguugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuggcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaaugggggaaauaggagcaauugcacuagacuucaagccuggaacuucaggaucuccuaucauaaauagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaagaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaucaguacauauucacgggccagccucucaacaaugacgaagaccaugcccacuggacagaagcaaaaaugcugcuagacaacauuaacacaccagaagggaucauaccagcucucuuugaaccagagagggagaagucagccgccauagacggugaauaccgccugaagggugaguccaggaagaccuucguggaacucaugaggaggggugaccucccaguuuggcuagcccacaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaccccuuagcacucaaggaauucaaggauuuugcagcuggcagaaagucaaucgcccuugaucuuguaacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauugcuuccaguggcauguuauggauggcugaugucccacuccaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacgaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuauguccacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccguggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacaaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuacgaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccauggcagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguuaggagccagguaccuugaguucgaagcacucggauuuuuaaaugaagaccacugguucucacgugaaaacucuuacaguggaguagaaggagaaggacugcacaagcugggauacauuuuaagagacauuucuaagauacccggaggagccauguaugcugaugacacagcuggcugggacacaagaauaacagaggaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagagguaguggacagguggggacuuauggucugaacacauucaccaacauggaagcccaguuagucagacagauggaaggagaaggcguguugucgaaggcagaccucgagaacccucaucugcuagagaagaaaaucacgcaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcucacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7308 - RNA, 9873 nt, Artificial Sequence
  derived and/or modified CDS sequence (wt) from DENV-3__GU131934__SS-prME
acaucgcucugucucaugaugauguuaccagcaacacuugcuuuccacuugacuucacgcgauggagagccgcgcaugauuguggggaagaaugaaagagggaaauccuuacuuuuuaagacagccucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggauugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugaaaaccuuaaauacacuguuaucaucacagugcacacaggagaccaacaccaggugggaaaugacacgcagggagucacaguugagauaacaccccaggcaucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaguuaucacacucuaucugggagccgugguacaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaaaccaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguuucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagugugaaaaaagaucugauuucauacggaggaggauggagauugagcgcacaauggcaaaagggagaggaggugcagguuauugccguagagccugggaagaacccaaaaaacuuucaaaccaucccgggcauuuuucagacaacaacgggggaaauaggagcaauugcacuagacuucaagccuggaacuucaggaucuccuaucauaaacagagagggaaagguggugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcagcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagacagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacaguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccuaggcuguggaagaggaggcuggucauauuauugcgcaggacugaaaaaaguuacagaagugcgaggauacacaaaaggcggcccaggacacgaagaaccaguacccaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccaugguuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7309 - RNA, 9873 nt, Artificial Sequence
  derived and/or modified CDS sequence (wt) from DENV-3__GU131935__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaauguccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucucugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcaacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaagauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggcuuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaaccgcaacaaaaucugaacacacaggaagggagauuguugauuuaaugugccacgcaacauucacaaugcgcuuacuaucaccagucaggguuccaaacuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggaguaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagauaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucuguguacaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagccgggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggagguuggucauauuauugcgcaggacugaaaaaaguuacagaagugcgaggauacacaaaaggcggcccaggacacgaagaaccaguaccuaugucuacauacggauggaacauagucaaguuaaugaguggaaaagacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuuguauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauucacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuuuaaagagaaaguggacaccaggacacccaggcccaugccagggacaagaaagguuauggagauuacagcggaauggcuuuggagaacucugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauucaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcaaugaagaauuucuggacuacaugccuucgaugaagagauucaggaaggaggaggagucagagggagccauuugguaa

SEQ ID NO: 7310 - RNA, 9873 nt, Artificial Sequence
  derived and/or modified CDS sequence (wt) from DENV-3__GU131936__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugcgugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguguguaagcacacauacguggauagagguuggggaaacgguugugguuuguuuggaaaaggaagcuuggugacaugcgcgaaauuucagugucuagaaucaauagagggaaaaguggugcaauaugaaaaccuuaaauacacugucaucaucacagugcacacaggagaccaacaccaggugggaaaugacacgcagggagucacaguugagauaacaccucaggcaucaacaguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucucguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauauaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagagcacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguaugguauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugaaaauaaaggaugaugagacugagaacauccuaacagugcucuuaaaaacagcauuacuaauaguuucaggcaucuuuccauacuccauacccgccacauuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguggugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucaugggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagauggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaagacguguucuaucuuccaccugaaaagugugacacccuauugugugacauuggagaaucuucaccaagcccaacaguggaagaaagcagaacuauaagaguuuugaagaugguugagccaugguuaagaagcaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaauggcaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacaccuaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuauaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7311 - RNA, 9873 nt, Artificial Sequence
  derived and/or modified CDS sequence (wt) from DENV-3__GU131937__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguagggaacagagauuuuguggaaggucugucaggagcuacguggguugauguggugcucgagcacggugggugugugaccaccauggcuaagagcaagccuacguuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagccgucuugccugaguauggaacccuugggcuagaaugcucaccacggacgggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaacgcacaugcaaaaaagcaagaagugguuguccuuggaucgcaagagggagcaaugcacacagcgcuaacaggagcuacagagauucaaaacucaggagguacaagcauuuuugcggggcacuugaaauguagacuuaagauggacaaacuggaacucaaggggaugagcuaugcaaugugcuugaacaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugguaagauguucgaggccacugcuagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauugugggaaaacaacaucaaauuaacgguaguugugggcgacauaauuggggucuuagagcaagggaaaagaacauuaacaccacagcccauggagcuaaaauauucauggaaaacauggggaaaggcaaaaauagugacagcugaaacacaaaauuccuccuucauaauagaugggccaaacacaccggaguguccaaguaccuuaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaacuacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuccucucaggacaaauaacauggagagauauggcacacacacucauaaugauuggguccaacgccuccgacaggaugggaauggguguuaccuauuuagcuuuaauugcaacauucaaaauccagccauucuuggccuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcaggucauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacugcaacacccccuggaacugcugaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaauggaaaaaaggucauccaacuuaguaggaagacuuuugauacagaauaucaaaagaccagacugaaugauugggacuucguggugacaacagacauuucagaaaugggagcuaacuucaaagcagauagagugauugacccaagaagaugucucaagccaguaaucuugacagauggacccgagcgagugauccuggcuggaccaaugccagucaccgcagcgagcgcugcgcaaaggagagggagaguuggcaggaauccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucucacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaaacagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagacugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuuggacagcaaagaguuuucaaagagaaaguggacaccaggacacccaggccuaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgggaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaagguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgacgacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7312 - RNA, 9873 nt, Artificial Sequence
  derived and/or modified CDS sequence (wt) from DENV-3__GU131938__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugcgugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaucaauagagggaaaaguggugcaauaugaaaaccuuaaauacacugucaucaucacagugcacacaggagaccaacaccaggugggaaaugacacgcagggagucacaguugagauaacaccucaggcaucaacaguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucucguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauauaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagagcacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguaugguauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcauuagucuccuuaacauguucaaacacaauuuucacguugacuguugccuggagaacagccaccuugauucuggccggaguuucgcuuuugccacugugccagucuucgaguaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugaaaauaaaggaugaugagacugagaacauccuaacagugcucuuaaaaacagcauuacuaauaguuucaggcaucuuuccauacuccauacccgccacauuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguggugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucaugggccagccucucaacaaugacgaagaccaugcccacuggacagaagcaaaaaugcugcuagacaacauuaacacaccagaagcgaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagauggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguucuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccuaggcuguggaagaggaggcuggucauauuauugcgcaggacugaaaaaaguuacagaagugcgaggauacacgaaaggcggcccaggacacgaagaaccaguaccuaugucuacauacggauggaacauagucaaguuaaugaguggaaaagacguguucuaucuuccaccugaaaagugugacacccuauugugugacauuggagaaucuucaccaagcccaacaguggaagaaagcagaacuauaagaguuuugaagaugguugagccaugguuaagaagcaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaauggcaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacaccuaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuauaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7313 - RNA, 9873 nt, Artificial Sequence
  derived and/or modified CDS sequence (wt) from DENV-3__GU131939__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccaaaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagcccacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagcugucuugcccgaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccuaucaacauugaggcugaaccuccuuuuggggaaagcaacauagugauuggaauuggagacaaagccuugaaaauuaacugguacaagaagggaagcucgauugggaagauguucgaggcuacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaggcugacauggggugcgucauaaacuggaaaggaaaagaacucaaauguggaaauggaauuuuugucacuaaugagguccacacuuggacagagcaguacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauucuucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucgcacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaaguccuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucucuuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaagagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuagucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacgacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccaacaccggaauuggaagaagaaauguucaaaaagcgaaaucuaacuauaauggaucuucauccugggucaggaaagacgcggaaauaucuuccagcuaucgucagagaagcaaucaagagacgucuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgccuacuaucaccagucaggguuccaaauuacaauuugauaauaauggaugaggcccauuucacagacccagccaguauagcggcuagaggguacauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaagggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggagaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggccgcgauaguagcagcuaaugaaaugggauuauuggaaaccacaaagagagaucuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaaucuacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcuggacugaaaaaaguuacagaagugcgaggguacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaaaugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggaucugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaacuaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucggaggcagaccucgagaacccucaucugcuagagaagaaaaucacacaaugguuggaaaccaaaggaguggagagauuaaaaagaauggcuaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuccuggacuacaugccuucgaugaagagauucaggaaggaggaggagucagagggagccauuugguaa

SEQ ID NO: 7314 - RNA, 9873 nt, Artificial Sequence
  derived and/or modified CDS sequence (wt) from DENV-3__GU131940__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcaucgagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagcccugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagccuuguuuagcggagucucauggauaaugaaaauuggaauagguguccucuuaaccuggauaggguugaauucaaaaaacacuuccaugucauuuucaugcauugugauaggaauuaucacacucuaucugggaaccgugguacaagcugacauggggugcgccauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuagagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugguaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagccaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagccuauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagauaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauugcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguguuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacggauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuaggcuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7315 - RNA, 9873 nt, Artificial Sequence
  derived and/or modified CDS sequence (wt) from DENV-3__GU131942__SS-prME
acaucgcucugucucaugaugauguucccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuaucuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaaucaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagccacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacagugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggguaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccauaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacuccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggauggcuguugguauggcauggaaauuagaccuaucaaugagaaagaagagaacauggugaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccaaccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaguuuucacguugacuguugccuggagaacagccaccuugauucuggccggaguuucgcuuuugccauugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuagcucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggcuagcgugaaaaaagaucugauuucauacggaggaggauggagauugaacgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccagggucaggaaagacgcggaaauaucuuccagccaucgucagagaagcaaucaagagacgcuuaagaacccuaauuuuggcaccaacaagagugguugcagcugagauggaagaagcacugaaaggacucccaauaagguaucaaacaacugcaacaaaaucugaacacacaggaagggagauuguugauuuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaacucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggagaauaccgccugaagggugaguccaggaagaccuucguggaacucaugaggaggggugaccucccaguuuggcuagcccauaaaguagccucagaagggaucaaauacacagacagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcgcucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagaucuaggaaugucuaaggaaccagguguuguuucuccaaccagcuauuuagauguagacuugcacccagcaucagccuggacauuguacgccguggccacaacaguaauaacaccaauguugagacauaccauagagaauucuacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggacugcaggccaaagccacucgugaagcucaaaaaagaacagcugcuggaauaaugaagaauccaacgguggacgggauaaugacaauagaccuagauccuguaauauacgauucaaaauucgaaaagcaacuaggacagguuaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuauuaugaaaucaguuggagcaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucguaaaacuccucacaaaaccaugggaugugguucccauggugacacagauggcaaugacagauacaacuccauuugggcagcaaagaguuuuuaaagagaaaguggacaccaggacacccaggcccaugccagggacaagaaagguaauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguauaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggauccugaacauagacaauuagcgaacgccauauuuaagcucacguaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagaaaagaaaaucacacaaugguuggaaaccaaaggaguggagagauuaaaaagaauggccaucagcggggaugauugcguggugaagccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuaugcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7316 - RNA, 9873 nt, Artificial Sequence
  derived and/or modified CDS sequence (wt) from DENV-3__GU131943__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaccaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucaccccauccaugacaaugagaugcgugggagugggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcaaggagucacgguugagauaacaccccaggcuucaaccguugaagcugucuugccugaguauggaacccuugggcuagaaugcucaccacggacaggccuggacuucaaugaaaugauuuuauugacaaugaaaaacaaagccuggaugguacauaggcaaugguucuuugaccuaccccuaccauggacaucaggagcuacaacagagacaccaauuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagaucccuuucuccacagaggacggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagcuugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaacgugugggagguggaagauuacggguuuggagucuucacaaccaacauauggcugaaacuccgagagguguacacccaaucaugugaccauaggcuaaugucggcggccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucucuagucucagcagggaguggaaagguggacaacuucacaaugggaguccuguguuuggcaauccucuucgaagaggugaugagaggaaaauuugggaaaaaacacaugauugcagggguucucuucacauuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguugugggcggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguagcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccacaccauguggcacgucacaagaggggcaguauugacgcacaaugggaaaagacuggaaccaaacugggccagcgugaaaaaagaccugauuucauacggaggaggauggagauugaacgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucucccaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaauuuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucgcguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagacuagauugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccguacuuauucagaucccuuagcacucaaggaauucaaggauuuugcagcugguagaaagucaaucgcccuugaucuugugacggaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauugucuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucuaugugcaguucaacuuuuguuaaugagaacaucaugggccuugugugaagcucuaacccuagcuacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacaugaagaaccaguaccuaugucuacauacggauggaauauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaauaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacuccuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuaugguuugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcaucuaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaagugagaagccuuauaggcgaugaagaauuucuggacuacaugccuucgaugaagagauucaggaaggaggaggagucagagggagccauuugguaa

SEQ ID NO: 7317 - RNA, 9873 nt, Artificial Sequence
  derived and/or modified CDS sequence (wt) from DENV-3__GU131945__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugcgugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaucaauagagggaaaaguggugcaauaugaaaaccuuaaauacacugucaucaucacagugcacacaggagaccaacaccaggugggaaaugacacgcagggagucacaguugagauaacaccucaggcaucaacaguugaagcugucuugccugaguauggaacccuugggcuagaaugcucaccacgaacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucucguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauauaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagagcacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguaugguauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugaaaauaaaggaugaugagacugagaacauccuaacagugcucuuaaaaacagcauuacuaauaguuucaggcaucuuuccauacuccauacccgccacauuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguggugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucaugggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagauggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaagacguguucuaucuuccaccugaaaagugugacacccuauugugugacauuggagaaucuucaccaagcccaacaguggaagaaagcagaacuauaagaguuuugaagaugguugagccaugguuaagaagcaaccaguuuugcauuaaaguauuaaacccuuacaugccaacugugauugaguaccuagaaagacuacaaagaaaauauggaggaaugcuugugagaaacccacucucacgaaacuccacgcaugaaauguacuggauauccaauggcaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacaccuaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuauaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7318 - RNA, 9873 nt, Artificial Sequence
  derived and/or modified CDS sequence (wt) from DENV-3__GU131946__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucucaggcacccagguuucaccauacuagcucuauuccuugcccauuacauaggcacuucccugacccagaaaguaguuauuuuuauacuacuaauguuggucacuccauccaugacaaugagaugcgugggaguagggaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacuguuaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggaggaacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagauacagccugggacuuugguucagugggugguauucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaaucaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaagaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugcugacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguucuguguuuggcaauccucuucgaagaagugaugagaggaaaauuugggaaaaaacacaugauugcagggguucucuucacguuugugcuccuccucucggggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccacacuauguggcacgucacaagaggggcaguauugacgcacaaugggaaaagacuggaaccaaacugggccagcgugaaaaaagaucugauuucauacggaggaggauggagauugagcgcacaauggcaaaaaggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaauuaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcucauuucacagacccagccaguauagcggcuagaggguacauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugcuugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucuuagaacucaugaggaggggugaccucccaguuuggcuagcccauaaaguagccucagaagggaucaaauacacagauagaaaauggugcuuugauggagaacguaauaaucaaauuuuagaggagaauauggauguggaaaucuggacaaaggaaggagaaaggaaaaaacugagaccuagguggcuugaugcccgcacuuauucagaucccuuagcacucaaggaauucaaggauuucgcagcuggcagaaagucaaucgcccucgaucuugugacagaaauaggaagagugccuucacacuuagcccacagaacgagaagcgcccuggacaacuuggugaugcugcacacgucagaacauggcgguagggccuacaggcaugcaguagaggaacuaccagaaacaauggaaacacuccuacucuugggacucaugaucuuacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaacuagcuauuuagauguagacuugcacccagcaucagccuggacacuguacgccguggccacaacaguaauaacaccaauguugagacacaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacugcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaggaaccaguaccuaugucuacauacggauggaacauagucaaguuaaugaguggaaaggacguguuuuaucuuccaccugagaagugugacacccuacugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggccuaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauaacgcgagagcugcuguugaggacgaggaauucuggaaacuuguggacagagaacgugaacuccacaaauugggcaaguguggaagcugcaucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaagguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggacagauuaaaaagaauggccaucagcggggaugauugcguggugaaaccgaucgaugacagguuugccaaugcccugcuugcccugaacgacaugggaaagguuaggaaggauauaccccaauggcagccaucaaagggguggcaugauuggcaacaggucccuuucugcucccaccacuuucacgaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaaaagauucaggaaggaggaggagucagagggagccauuugguaa

SEQ ID NO: 7319 - RNA, 9873 nt, Artificial Sequence
  derived and/or modified CDS sequence (wt) from DENV-3__FJ639712__SS-prME
acaucgcucugucucaugaugauguucccagcaacacuugcuuuucacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuggcucuauuucuugcccauuacauaggcacuucccugacccagaaagugguuaucuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggauauagagcuucagaagaccgaggccacccaacuggcgacccuaaggaaguuaugcauugagggaaaaaucaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugauacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagccacagagauucaaaacucaggagguacaagcauuuuugcggggcaccugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacagugguagauugaucacagccaacccaguggugaccaagaaggaggagccugucaacauugaggcugaaccuccuuuuggggaaagcaacauagugauuggaauuggagacaaagccuugaaaauuaacugguacaagaaggggagcucgauugggaagauguucgaggccacugccagaggugcaagacgcauggccaucuugggagacacagccugggacuuugguucagugggugguguucuaaauucauuagggaaaauggugcaccaaauauucggaagugcuuacacagcccuguuuagcggagucucauggguaaugaaaauaggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggccacagccaucgcaggcgcuugggaaaauggagucuguggaaucaggucaacaaccagaauggagaaucuauuguggaagcaaauagccaaugagcugaacuacauauuaugggaaaacaacaucaaauuaacggugguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacuccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccgaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuuuaacuauugugaaggaacaacaguagucauuacagaaaacugugggacaagaggcccaucauugagaacaacaacggugucagggaagcugauacacgaaugguguugccgcucgugcacacuuccucccuugcgauacaugggagaggauggcuguugguauggcauggaaauuagaccuaucaaugagaaagaagagaacauggugaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccacccugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuuggaaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacccuaauuuuggcaccaacaagagugguugcagcugagauggaagaagcacugaaaggacucccaauaagguaucaaacaacugcaacaaaaucugaacacacaggaagggagauuguugauuuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaacucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugaaugggacuucguggugacaacagacauuucagaaaugggagcuaacuuuaaagcagauagagugauugacccaagaagaugucucaagccaguaaucuugacagauggaccugagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacgcagacagaaaauggugcuuugauggagaacguaauaaucaaauuuuagaggagaacauggauguggaaaucuggacaaaagaaggagaaaggaaaaaacugagaccuagguggcuugacgcccgcacuuauucagaucccuuagcgcucaaggaauucaaggauuuugcagcuggcagaaagucaaucgcccuugaucuugugacagaaauaggaagagugcccucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacauuggcugcgauaguagcagcuaaugaaaugggauuauuggaaacuacaaagagagauuuaggaaugucuaaggaaccagguguuguuucuccaaccagcuauuuagauguagacuugcacccagcaucagccuggacauuguacgccguggccacaacaguaauaacaccaauguugagacauaccauagagaauucuacggcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggacugcaggccaaagccacucgugaagcucaaaaaagaacagcugcuggaauaaugaagaacccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuuccaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuuuaaagagaaaguggacaccaggacacccaggcccaugccagggacaagaaagguaauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggauccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaagccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuaugcucaaauguggagucucauguauuuucacagaagagaucuuagacuagcauccaacgccauuuguucagcaguaccaguccauuggaucccuacaagcagaacgacaugguccauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7320 - RNA, 9873 nt, Artificial Sequence
  derived and/or modified CDS sequence (wt) from DENV-3__FJ639713__SS-prME
acaucgcucugucucaugaugauguuaccagcaacacuugcuuuccacuugacuucacgcgauggagagccgcgcaugauuguggggaagaaugaaagagggaaauccuuacuuuucaagacagcuucuggaaucaacaugugcacucucauagcuauggacuugggagagaugugugaugacacggucacuuauaagugcccccucauugcugaaguggaaccagaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugcgugaccaccauggcuaagagcaagccuacgcuggacauagagcuucaaaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauauguggacagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccucaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaaacaagaagugguuguccuuggaucgcaagagggagcaaugcacacagcgcugacaggagcuacagagauucaaaacucaggagguacaagcauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccaccgccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacaguaucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguaccuagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuccagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccccuuaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccauagaacgagaaacgcccuggacaacuuggugaugcugcacacgucagaacauggcgguagggccuacagacaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaucagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaggaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaauaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagcuuccuccaugauaaauggagucgugaaacuccucacaaaaccaugggaugugguucccauggugacacagauggcaaugacagauacaacuccauuugggcagcaaagagucuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaauaugaugggcaagagagagaaaaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucauacaaugguuggaaaccaaaggaguggagagauuaaaaagaauggccaucagcggggaugauugcguggugaaaccgaucgaugacagguuugccaaugcccugcuugccuugaacgacaugggaaaggucaggaaggacauaccccaauggcagccaucaaagggguggcaugauuggcaacaggucccuuucugcucccaccacuuucaugaacugaucaugaaagauggaagaaagcuggugguucccugcagaccccaggacgaacuaauaggaagggcgagaaucucucaaggagcaggauggagccuuaaagaaacugcaugccuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuucugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7321 - RNA, 9873 nt, Artificial Sequence
  derived and/or modified CDS sequence (wt) from DENV-3__FJ639714__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaauuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugaaaaccuuaaauacacugucaucaucacagugcacacaggagaccaacaccaggugggaaaugacacgcagggagucacaguugagauaacaccccaggcaucaaccguugaagcugucuugccugaguauggaacccuuggacuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaguggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauucagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcacuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguuucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccagguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguggugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuucguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggcuuacaggcaugcaguagaggaacuaccagaaacaauggaaacacuccuacucuugggacucaugaucuuauuaacagguggagcaaugcuuuucuugauaucagguaaagggauuggaaagacuucaauaggacuuauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagauuugcacccagcaucagccuggacauuguacgccguggccacaacaauaauaacaccaauguugagacauaccauagagaauuccacagcaaauguuucccuggcagccauagcuaaccaggcagugguccugauggguuuagacaaaggauggccaauaucgaaaauggaccuaggcguaccgcuauuggcacugggcugcuauucacaagugaacccacugacucucacagcggcaguacuucugcuaguuacacauuaugccauuauagguccaggauugcaggcuaaagccacucgugaagcccaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugaggacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccuaggcuguggaagaggaggcuggucauauuauugcgcgggacugaaaaaaguuacagaagugcgaggauacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccaugguuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaagacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccuggacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaggaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7322 - RNA, 9873 nt, Artificial Sequence
  derived and/or modified CDS sequence (wt) from DENV-3__FJ639715__SS-prME
acaucgcucugucucaugaugauguuaccagcaacacuugcuuuccacuugacuucacgcgauggagagccgcgcaugauuguggggaagaaugaaagagggaaauccuuacuuuuuaagacagccucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagcugucuugcccgaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcucugacaggagcuacagagauucaaaacucaggagguacaaacauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccuaucaacauugaggcugaaccuccuuuuggggaaagcaacauagugauuggaauuggagacaaagccuugaaaauuaacugguacaagaagggaagcucgauugggaagauguucgaggcuacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuugaccuggauaggguugaauucaaaaaacacuuccaugucauuuucaugcauugugauaggaauuaucacacucuaucugggagccgugguacaggcugacauggggugcgucauaaacuggaaaggaaaagaacucaaauguggaaauggaauuuuugucaccaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccugcaccuggccgaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcggaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucucuuuaacauguucaaacacaauuuucacguugacgguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaagagcuggccacugaaugagggagugauggcuguugggcuugugagcauuuuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggauuaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacgacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccaacaccggaauuggaagaagaaauguucaaaaagcgaaaucuaacuauaauggaucuucauccugggucaggaaagacgcggaaauaucuuccagcuaucgucagagaagcaaucaagagacgccuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugauaauaauggaugaggcccauuucacagacccagccaguauagcggcuagaggguacauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuucgaaccagagagggagaagucagccgcuauagacggugaauaccgccugaagggugaguccaggaagacuuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcaccuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacauuggccgcgauaguagcagcuaaugaaaugggauuauuggaaaccacaaagagagaucuaggaaugucuaaagaaccagguguuguuucuccaaccagcuauuuagauguagacuugcacccagcaucagccuggacauuguacgccguggccacaacagugauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaaucuacgauucaaaauucgaaaagcaacuaggacaggucaugcucuugguuuugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaucuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcuggacugaaaaaaguuacagaagugcgaggguacacaaaaggcgguccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaaaugugauugagcacuuagaaagacuacaaagaaaauauggaggaaugcuugugagaaacccacucucacgaaacuccacgcaugaaauguacuggauauccaaugguaccggcaacaucgucuccucagucaacaugguauccagauugcuacugaacagauuuacgaugacacacaggagacccaccauagagaaagauguggaucugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucggaggcagaccucgagaacccucaucugcuagagaagaaaaucacacaaugguuggaaaccaaaggaguggagagauuaaaaagaauggcuaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuccuggacuacaugccuucgaugaagagauucaggaaggaggaggagucagagggagccauuugguaa

SEQ ID NO: 7323 - RNA, 9873 nt, Artificial Sequence
  derived and/or modified CDS sequence (wt) from DENV-3__KF955461__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagaacaagcccacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagccacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguccuaaauucauuagggaaaauggugcaccaaguauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagccaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacuuccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucaagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuauguuauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagauccagccaguauagcggcuagaggguacauaucaacucguguaggaaugggagaggcagcugcaauuuucaugacagcaacacccccuggaacugcugaagccuuuccucagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaaugcugagacauaccauagagaauuccacagcaaauguaucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagagacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucagcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggaaucagagggagccauuugguaa

SEQ ID NO: 7324 - RNA, 9873 nt, Artificial Sequence
  derived and/or modified CDS sequence (wt) from DENV-3__FJ639719__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcauuagcuccccaugucggcaugggacuggacacacguacccaaaccuggaugucggcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacggagauucaaaacucaggagguacaagcauuuuugcggggcacuugaaauguaggcuuaagauggacaaauuggaacucaaggggaugagcuaugcaaugugcuugaauaccuuuguguugaagaaagaagucuccgagacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccuccuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaucacaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguacuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuacccaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcacuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcugucgggcuugugagcauucuggcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguauauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaucugauuucauacggaggaggauggagauugagcacacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggauuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcaggaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugguaucagguaaagggauuggaaagacuacaauaggacucauuuguguuaucguuuccagugguauguuauggauggcugauaucccacuucaauggaucgcgucggcuauaguccuggaauuuuucaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugacuugcacaaugaggaaaaaaucacacagcaaauggacccugaacacagacaauuagcgaacgccauauucaagcucacauaccaaaacaaaguggucaaaguacaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucuguuagagaagaaaaucacacaaugguuggaaaacaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuggcauccaacgccauuuguucagcagugccaguccauugggucccuacgagcagaacgacauggucuauucacgcucaccaucaguggaugaccacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7325 - RNA, 9873 nt, Artificial Sequence
  derived and/or modified CDS sequence (wt) from DENV-3__KF955332__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacggagauucaaaacucaggagguacaagcauuuuugcggggcacuugaaauguaggcuuaagauggacaaauuggaacucaaggggaugagcuaugcaaugugcuugaauaccuuuguguugaagaaagaagucuccgagacgcagcaugggacaauacucauuaagguugaguacaaaggggaagaugcaccuugcaagauuccuuucuccacagaggauggacaagggaaagcccacaaugguagacugauuacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaucacaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgagugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguacuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcacuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacgcacccaaaaggaggagcuggccacugaaugagggagugauggcugucgggcuugugagcauucuggcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaucugauuucauacggaggaggauggagauugagcacacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggauuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaccaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcaggaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugguaucagguaaagggauuggaaagacuacaauaggacucauuuguguuauuguuuccaguggcauguuauggauggcugauaucccacuucaauggaucgcgucggcuauaguccuggaauuuuucaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguagccacaacaguaauaacaccaauguugagacauaccauagagaauuccacagcaaauguguccuuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugacuugcacaaugaggaaaaaaucacacagcaaauggacccugaacacagacaauuagcgaacgccauauucaagcucacauaccaaaacaaaguggucaaaguacaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaagacagaccucgagaacccucaucuguuagagaagaaaaucacacaaugguuggaaaacaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7326 - RNA, 9873 nt, Artificial Sequence
  derived and/or modified CDS sequence (wt) from DENV-3__FJ639720__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacggagauucaaaacucaggagguacaagcauuuuugcggggcacuugaaauguaggcuuaagauggacaaauuggaacucaaggggaugagcuaugcaaugugcuugaauaccuuuguguugaagaaagaagucuccgagacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugagaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaucacaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguacuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcacuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcugucgggcuugugagcauucuggcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaaacaaacccaaagaucuggcguucuaugggacguacccagccccccagaaacacagaaagcagaacuggaagagggggucuauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaucugauuucauacggaggaggauggagauugagcacacaauggcaaaaaggagaggagguacagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggauuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaauaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaccaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcaggaagucaaucgccauugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugguaucagguaaagggauuggaaagacuacaauaggacucauuuguguuauuguuuccaguggcauguuauggauggcugauaucccacuucaauggaucgcgucggcuauaguccuggaauuuuucaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguguccuuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugacuugcacaaugaggaaaaaaucacacagcaaauggacccugaacacagacaauuagcgaacgccauauucaagcucacauaccaaaacaaaguggucaaaguacaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaagacagaccucgagaacccucaucuguuagagaagaaaaucacacaaugguuggaaaacaaaggaguggagagauuaaaaagaauggccaucagcggggaugauugcguggugaaaccgaucgaugacagguuugccaaugcccugcuugcccugaacgacaugggaaagguuaggaaggauauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7327 - RNA, 9873 nt, Artificial Sequence
  derived and/or modified CDS sequence (wt) from DENV-3__GQ868626__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgugacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaggcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacuguuaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaauagagacaccaacuuggaacaggaaagagcuucuuguaacauucaaaaaugcacaugcaaaaaagcaagaaguaguuguccuuggaucgcaagagggagcaaugcacacagcgcugacaggagcuacggagauucaaaacucaggagguacaagcauuuuugcggggcacuugaaauguaggcuuaagauggacaaacuggaacucaaggggaugagcuaugcaaugugcuugaauaccuuuguguugaggaaagaagucuccgagacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacacuuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagccggucccauuucacaacacaaucauaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgaaugguguugccgcucaugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcugucgggcuugugagcauucuggcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuugaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggcaagugugaaaaaagaucugauuucauacggaggaggauggagauugagcacacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaacucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagccuauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucggaucccuuagcacucaaggaauucaaggauuuugcagcuggcaggaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuacaauaggacucauuugugucauuguuuccaguggcauguuauggauggcugauaucccacuucaauggaucgcgucggcuauaguccuggaauuuuuuaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccugugauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaagucacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguacuggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuucacaaauugggcaaguguggaagcugcgucuacaacaugaugggcaagagagagaagaaacuuggagaguuuggcaaagcaaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugaccugcacaaugaggaaaaaaucacacagcaaauggacccugaacacagacaauuagcgaacgccauauucaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucuguuagagaagaaaaucacacaaugguuggaaaacaaaggaguggagagauuaaaaagaauggccaucagcggggaugauugcguggugaaaccgaucgaugacagguuugcuaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagcuuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuugcugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7328 - RNA, 9873 nt, Artificial Sequence
  derived and/or modified CDS sequence (wt) from DENV-3__GQ868627__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgugacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaggcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacuguuaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacggagauucaaaacucaggagguacaagcauuuuugcggggcacuugaaauguaggcuuaagauggacaaacuggaacucaaggggaugagcuaugcaaugugcuugaauaccuuuguguugaggaaagaagucuccgagacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacacuuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagccggucccauuucacaacacaaucauaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgaaugguguugccgcucaugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcugucgggcuugugagcauucuggcuaguucucuccuuaggaaugaugugcccauggcuggaccauuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuugaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaucugauuucauacggaggaggauggagauugagcacacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaacugcaacaaaaucugaacacacaggaagggagauuguugauuuaaugugccacgcaacauucacaaugcgcuugcuaucaccagucaggguuccaaauuacaaucugauaauaauggaugaggcccauuucacagauccagccaguauagcggcuagaggguacauaucaacccguguaggaaugggagaggcagcugcaauuuucaugacagcaacacccccuggaacugcugaagccuuuccccagagcaacgcuccaauucaagaugaagaaagggauauuccggaacgcucguggaacucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagccuauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucggaucccuuagcacucaaggaauucaaggauuuugcagcuggcaggaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuacaauaggacucauuuguguuauuguuuccaguggcauguuauggauggcugauaucccacuucaauggaucgcgucggcuauaguccuggaauuuuuuaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucuguuagucacacauuaugccauuauagguccaggauugcaggcuaaagccacucgugaagcucaaaaaagaacagcugcuggaauaaugaagaauccaacgguggaugggauaaugacaauagaccuagauccugugauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaagucacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguacuggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuucacaaauugggcaaguguggaagcugcgucuacaacaugaugggcaagagagagaagaaacuuggagaguuuggcaaagcaaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugaccugcacaaugaggaaaaaaucacacagcaaauggacccugaacacagacaauuagcgaacgccauauucaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucuguuagagaagaaaaucacacaaugguuggaaaacaaaggaguggagagauuaaaaagaauggccaucagcggggaugauugcguggugaaaccgaucgaugacagguuugcuaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagcuuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuugcugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagaaggagccauuugguaa

SEQ ID NO: 7329 - RNA, 9873 nt, Artificial Sequence
  derived and/or modified CDS sequence (wt) from DENV-3__FJ639721__SS-prME
acaucgcucugccucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugucgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucagcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugaugugguguuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacugucaucaucacagugcacacaggagaccaacaccaggugggaaaugacacacagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucucguaacauucaaaaaugcacaugcaaaaaagcaagaaguaguuguccuuggaucgcaagagggagcaaugcacacagcgcugacaggagcuacggagauucaaaacucaggagguacaagcauuuucgcggggcacuugaaauguaggcuuaagauggacaaauuggaacucaaggggaugagcuaugcaaugugcuugaauaccuuuguguugaagaaagaagucuccgagacgcagcaugggacaauacucauuaagguugaguacaaaggggaagaugcaccuugcaagauuccuuucuccacagaggauggacaagggaaagcccacaaugguagacugauuacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaucacaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgagugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguacuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuugacuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacgcaauuugagacauaucaguuguggacggcacuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacgcacccaaaaggaggagcuggccacugaaugagggagugauggcugucgggcuugugagcauucuggcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaccugauuucauacggaggaggauggagauugagcacacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggauuguauggcaauggagugguuacaaaaaaugguggcuacgucaguggaauagcgcaaacaaaugcagaaccagacggaccgacaccggaauuggaagaagaaauguuuaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucuuaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgccauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaccaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcaggaagucaauugcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugguaucagguaaagggauuggaaagacuacaauaggacucauuuguguuauuguuuccaguggcauguuauggauggcugauaucccacuucaauggaucgcgucggcuauaguccuggaauuuuucaugaugguguugcucauaccagaaccagaaaaacaaagaacuccccaagacaaccaacucgcauaugucgugauaggcauacucacacuggcugcaauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguagccacaacaguaauaacaccaauguugagacauaccauagagaauuccacagcaaauguguccuuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacaguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuaucuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccggaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcgaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugacuugcacaaugaggaaaaaaucacacagcaaauggacccugaacacagacaauuagcgaacgccauauucaagcucacauaccaaaacaaaguggucaaaguacaacgaccaacuccaaaaggcacgguaauggacaucauaucuaggaaagaccaaagaggcaguggacagguggggacuuauggacugaacacauucaccaacauggaagcccaguuagucagacagauggaaggagaaggcguguugucgaagacagaccucgagaacccucaucuguuagagaagaaaaucacacaaugguuggaaaacaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7330 - RNA, 9873 nt, Artificial Sequence
  derived and/or modified CDS sequence (wt) from DENV-3__FJ639722__SS-prME
acaucgcucugccucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucagcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauacgagaaccucaaauacacugucaucaucacagugcacacaggagaccaacaccaggugggaaaugacacacagggagucacgguugagauaacaccccaggcaucaaccguugaagcugucuugccugaguauggaacccuugggcuggaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucucguaacauucaaaaaugcacaugcaaaaaagcaagaaguaguuguccuuggaucgcaagagggagcaaugcacacagcgcugacaggagcuacggagauucaaaacucaggagguacaagcauuuucgcggggcacuugaaauguaggcuuaagauggacaaauuggaacucaaggggaugagcuaugcaaugugcuugaauaccuuuguguugaagaaagaagucuccgagacgcagcaugggacaauacucauuaagguugaguacaaaggggaagaugcaccuugcaagauuccuuucuccacagaggauggacaagggaaagcccacaaugguagacugauuacagccaacccaguggugaccaagaaggaggagccugucaacauugaggcugaaccuccuuuuggggaaagcaacauagugauuggaauuggagaaaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaucacaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgagugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguacuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcacuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacgcaccuaaaaggaggagcuggccacugaaugagggagugauggcugucgggcuugugagcauucuggcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacugcuggucuggcauacuuggcaaaagcaaacccaaagaucuggcguucuaugggacguacccagccccccagaaacacagaaagcagaacuggaagagggggucuauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaccugauuucauacggaggaggauggagauugagcacacaauggcaaaaaggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggauuguauggcaauggagugguuacaaaaaaugguggcuacgucaguggaauagcgcaaacaaaugcagaaccagacggaccgacaccggaauuggaagaagaaauguuuaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgccauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaccaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcaggaagucaauugcccuugaucuugugacagaaauaggaagagugccuucacacuuggcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugguaucagguaaagggauuggaaagacuacaauaggacucauuuguguuauuguuuccaguggcauguuauggauggcugauaucccacuucaauggaucgcgucggcuauaguccuggaauuuuucaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguagccacaacaguaauaacaccaauguugagacauaccauagagaauuccacagcaaauguguccuuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacaguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuaucuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcgaaaggcaguagagcuauaugguacauguggcugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugacuugcacaaugaggaaaaaaucacacagcaaauggacccugaacacagacaauuagcgaacgccauauucaagcucacauaccaaaacaaaguggucaaaguacaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaagacagaccucgagaacccucaucuguuagagaagaaaaucacacaaugguuggaaaacaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7331 - RNA, 9873 nt, Artificial Sequence
  derived and/or modified CDS sequence (wt) from DENV-3__FJ639723__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuacuggaaucaacaugugcacacucauagcuauggacuugggagagaugugugaugacacggucacuuauaaaugcccccucauugccgaaguggaaccugaagacauugacugcuggugcaaccuuacaucggcaugggugacuuacggaacgugcaaucaagcuggggagcauagacgugacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcucauuacauaggcacuucccugauccagaaaguggucauuuuuauacuacuaaugcuggucacuccauccaugacaaugagaugcgugggaguaggaaacagagauuuuguggaaggucugucaggagcuacguggguugauguggugcuagagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaggcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccucaaauacacuguuaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcaacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacggagauucaaaacucaggagguacaagcauuuuugcggggcacuugaaauguaggcuuaagauggacaaacuggaacucaaggggaugagcuaugcaaugugcuugaauaccuuuguguugaggaaagaagucuccgagacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguuugaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacacuuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagccggucccauuucacaacacaaucauaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacacgaaugguguugccgcucaugcacacuuccucccuugcgauacaugggagaggacggcugcugguauggcauggaaauuagaccuaccaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcugucgggcuugugagcauucuggcuaguucucuccuuaggaaugaugugcccauggcuggaccauuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaaucuuugggaaaacccaaguggggguuggagugcagaaagaaggagucuuccacaccauguggcacgucacaagaggggcaguguugacgcacaaugggaaaagacuggaaccaaacugggcaagugugaaaaaagaucugauuucauacggaggaggauggagauugagcacacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuaugucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagauaucaaacaacugcaacaaaaucugaacacacaggaagggagauuguugauuuaaugugccacgcaacauucacaaugcgcuugcuaucaccagucaggguuccaaauuacaaucugauaauaauggaugaggcccauuucacagauccagccaguauagcggcuagaggguacauaucaacccguguaggaaugggagaggcagcugcaauuuucaugacagcaacacccccuggaacugcugaagccuuuccccagagcaacgcuccaauucaagaugaagaaagggauauuccggaacgcucguggaacucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggccggaccaaugccagucaccgcagcaagcgcugcgcaaaggagagggagaguuggcaggaacccacaaaaagaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagccuauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucggaucccuuagcacucaaggaauucaaggauuuugcagcuggcaggaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuacaauaggacucauuuguguuauuguuuccaguggcauguuauggauggcugauaucccacuucaauggaucgcgucggcuauaguccuggaauuuuuuaugaugguguugcucauaccagaaccagaaaaacaaagaacuccccaagacaaccaacucgcauaugucgugauaggcauacucacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggacuuaggcguaccgcuacuggcacugggcugcuauucacaagugaacccacugacucucacagcggcaguacuucuguuagucacacauuaugccauuauagguccaggauugcaggcuaaagccacucgugaagcucaaaaaagaacagcugcuggaauaaugaagaauccaacgguggaugggauaaugacaauagaccuagauccugugauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaagucacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaaccauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguacuggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguauuuaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuucacaaauugggcaaguguggaagcugcgucuacaacaugaugggcaagagagagaagaaacuuggagaguuuggcaaagcaaaaggcaguagagcuauaugguacaugugguugggagcuagguuccuugaguucgaagcacucggauuuuuaaaugaagaccacugguucucgcgugaaaacucuuacaguggaguagaaggagaaggacugcacaagcugggauacauuuuaagagacaucucuaagauacccggaggagccauguaugcugaugacacagcugguugggacacaagaauaacagaagaugaccugcacaaugaggaaaaaaucacacagcaaauggacccugaacacagacaauuagcgaacgccauauucaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucuguuagagaagaaaaucacacaaugguuggaaaacaaaggaguggagagauuaaaaagaauggccaucagcggggaugauugcguggugaaaccgaucgaugacagguuugcuaaugcccugcuugcccugaacgacaugggaaagguuaggaaggacauaccucaauggcagccaucaaagggguggcaugauuggcaacaagucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagcuuacgcucaaauguggagucucauguauuuucacagaagagaucuuagacuggcauccaacgccauuuguucagcagugccaguccauugggucccuacgagcagaacgacauggucuauucacgcucaccaucaguggaugacuacagaagacaugcuugcugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagaaggagccauuugguaa

SEQ ID NO: 7332 - RNA, 9873 nt, Artificial Sequence
  derived and/or modified CDS sequence (wt) from DENV-3__FJ639724__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucaccuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaggguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccacaggcccggguaccacacccaaacgacaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagacauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauugcuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucacccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagacuagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcccuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggaucugggagcaggaacucgacaugucaaugcggaaccagaaacacccaacauggaugucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuuccaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7333 - RNA, 9873 nt, Artificial Sequence
  derived and/or modified CDS sequence (wt) from DENV-3__FJ639725__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugaccuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuaucuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauuuuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagaccccgccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugaggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacaucuagcccacagaacgagaaacgcccuggacaacuuggugaugcugcauacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauugcuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagauuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaauaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauucgggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggggccagguaccuugaguucgaagcacucggauuuuuaaaugaagaccacugguucucgcgugaaaacucuuacagugggguagaaggagaaggacugcacaaguugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagggaagaaaaucacacaaugguuggaaaccaaaggaguggagagauuaaaaagaauggccaucagcggggaugauugcguggugaaaccgaucgaugacagguuugccaaugccuugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggauccccacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuaggaaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauuuaggaaggaggaggagucagagggagccauuugguaa

SEQ ID NO: 7334 - RNA, 9873 nt, Artificial Sequence
  derived and/or modified CDS sequence (wt) from DENV-3__FJ639726__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaggguagagacaugggcucuuaggcacccagguuucaccauacuagcucuauuucuugcccauuacauaggcacuucccugacccagaaaguggucauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagcccacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaaugguacaccaaauauucggaagugcuuacacagcccuguuuagcggagucucauggauaaugaaaauuggaauagguguccucuuaaccuggauaggauugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaauggcguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagacauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggaguaauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacguggcaaaagcaaacccaaagaucuggcguucuaugggacguacccagccccccagaaacacagaaagcagaacuggaagagggggucuauaggaucaaacaacaaggaauuuuugggaaaacccaaguggggguaggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucucccaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucacccugggucaggaaagacgcggaaauaucuuccagccaucgucagagaagcaaucaagagacgcuuaagaacucuaauuuuggcaccaacaagagugguugcugcugagauggaagaagcacugaaaggacucccaauaagguaucaaacaaccgcaacaaaaucugaacacacaggaagggagauuguugaucuaaugugccacgcaacauucacaaugcgccuacuaucaccggucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguugaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuagcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuucaccugaaaagugugacacccuauugugugacauuggagaaucuucaccaagcccaacaguggaagaaagcagaacuauaagaguuuugaagaugguugagccauggcuaagaaacaaccaguuuugcaucaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcagggacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7335 - RNA, 9873 nt, Artificial Sequence
  derived and/or modified CDS sequence (wt) from DENV-3__KF955333__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgcgcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggauggcugcugguauggcauggaaauuagaccuaucaaugagaaagaagagaacaugguaaagucuuuagucucagcggggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaagccagcagauguaccaugggaggaagaggcugagcaaacaggagugucccacaauuugaugaucacaguugaugaugauggaccaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaccaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaacaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucucggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguuccuauggugacacagauggcaaugacagauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacagcgcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7336 - RNA, 9873 nt, Artificial Sequence
  derived and/or modified CDS sequence (wt) from DENV-3__GQ868628__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuauauaggcacuucccugacccagaaagugguuauuuuuauacuacuaaugcuggucacuccauccaugacaaugagaugcgugggaguagggaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacgggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugcaagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccugugcuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuccucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugcuugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacuggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaagguggucaaaguucaacgaccaacuccaaaaggcacgguaauggacaucauaucuaggaaagaccaaagaggcaguggacagguggggacuuauggucugaacacauuuaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaaaggguggcaugauuggcaacaggucccuuucugcucccaccacuuucaugaacugaucaugaaagacggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7337 - RNA, 9873 nt, Artificial Sequence
  derived and/or modified CDS sequence (wt) from DENV-3__FJ639727__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacggugcacacaggagaccaacaccaggugggaaaugauacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagaaggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaaucccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuacuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagacuacggguuuggagucuucacaaccaacauauggcugaaacuccgagagguguacacccaaucaugugaucauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacauacucuuuggagcaaugguguacuagagagugacaugaucaucccaaagagucuagcugguccuauuucacaacacaaccacaggcccggguacuacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcaggggcucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuuuacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaccuaacuauaauggaucuucaucccgggucaggaaagacgcggaaauaucuuccagccaucgucagagaagcaaucaagagacgcuuaagaacucuaauuuuggcaccaacaagagugguugcagcugagauggaagaagcacugaaaggacuuccaauaagguaccaaacaacugcaacaaaaucugaacacacaggaagggagauuguugaucuaaugugccacgcaacauucacaaugcgcuuauuaucaccagucaggguuccaaauuacaauuugguaguaauggaugaggcccauuucacagacccagccaguauagcggcuagaggguacauaucaacucguguaggaaugggagaggcagcugcaauuuucaugacagcaacacccccuggaacugcugaagccuuuccucagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaaugggaaaaaggucauccaacuuaguaggaagaccuuugauacagaauaucaaaagaccagacugaaugauugggacuucguggugacaacagacauuucagaaaugggagcuaacuuuagagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugagccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacucacacuggcugcgauaguagcagcuaaugaaaugggauuauuggaaaccacaaagagagauuuaggaaugucuaaagaaccagguguuguuuccccaaccagcuauuuagauguagacuugcacccagcaucagccuggacauuguacgccguggccacaacaguaauaacaccaauguugagacauaccauagagaauuccacagcaaaugucucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauugaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucaucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacucccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagacuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7338 - RNA, 9873 nt, Artificial Sequence
  derived and/or modified CDS sequence (wt) from DENV-3__GQ868629__SS-prME
acaucgcucugucucaugaugauguuaccagcaacacuugcuuuccacuugacuucacgcgauggagagccgcgcaugauuguggggaagaaugaaagagggaaauccuuacuuuucaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguagggaacagagauuuuguggaaggucuaucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaagggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacgggcuuggauuucaaugaaaugauuuuauugacaaugaaaaacaaagccuggaugguacauaggcaaugguucuuugaccuaccccuaccauggacaucaggagcuauaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcaucuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugcuagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuccucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaauugauaacacaauuugagacauaucaguuguggacggcauuagucuccuuaacauguucuaacacaauuuucacguugacuguugccuggaggacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggauguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggaucaccgacuuuguugggaagacggugugguuugucccuagcaucaaagccggaaaugacauagcaaacugcuugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaagguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugaggagccuuauaggcgaugaagaauuucuggacuacaugccuucgaugaagagauucaggaaggaggaggagucagagggagccauuugguaa

SEQ ID NO: 7339 - RNA, 9873 nt, Artificial Sequence
  derived and/or modified CDS sequence (wt) from DENV-3__FJ639728__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguagggaacagagauuuuguggaaggucugucaggagcuacguggguugauguggugcucgagcacggugggugugugaccaccauggcuaagagcaagccuacguuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacgggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugcuagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccuuaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuccucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagccgcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugcuugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugauccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauuguuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacaggcucagccuccucuaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaagguggucaaaguucaacgaccaacuccaaaaggcacgguaauggauaucauaucuaggaaagaccaaagaggcaguggacagguggggacuuauggucugaacacauucaccaacauggaagcccaguuagucagacagauggaaggagaagguguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7340 - RNA, 9873 nt, Artificial Sequence
  derived and/or modified CDS sequence (wt) from DENV-3__FJ639729__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguagggaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaagggaagcuuggugacaugcgcgaaauuucaaugucuagaaccaauagagggaaaaguggugcaauaugagaaccuuaaauacacuguuaucaucacagugcacacaggagaccaacaccaggugggaaaugacacgcagggagucacgguugagauaacaccccaggcaucaaccguugaagcugucuugccugaguauggaacccuugggcuagaaugcucaccacggacgggcuuggauuucaaugaaaugauuuuauugacaaugaaaaacaaagccuggaugguacauaggcaaugguucuuugaccuaccccuaccauggacaucaggagcuauaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcaucuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggagagcaacauagugauuggaauuggagacaaagccuugaaaauuaacugguacaagaagggaagcucgauugggaagauguucgaggccacugcuagaggugcaaggcgcauggccaucuugggagacacagccugggacuuugguucagugggugguguucuaaauucauuagggaaaauggugcaccaaauauucggaagugcuuauacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaacuaacauauggcugaaacuccgagagguguauacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucaggaaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauucgggaaaaaacacaugauugcagggguucucuucacguuugugcuccuccucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucguggaauucaggcaaugaauggaucaccgacuuuguugggaagacggugugguuugucccuagcaucaaagccggaaaugacauagcaaacugcuugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauauggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagcuacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagcuagguaccuugaguucgaagcacucggauuuuuaaaugaagaccacugguucucgcgugaaaacucuuacaguggaguagaaggagaaggacugcauaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauuuaagcucacauaccaaaacaagguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggaaucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7341 - RNA, 9873 nt, Artificial Sequence
  derived and/or modified CDS sequence (wt) from DENV-3__FJ639730__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggagagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguuguggcuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagaaggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacugguacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagauuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacaaagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacauacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuuaacagauggacccgagcgagugauccuggcuggaccaaugccagucaccgcagcgagcgcugcgcaaaggagagggagaguuggcaggaacccacaaaaggaaaaugaccaguacauauuuacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuuccaucaugaaaucaguuggaacaggaaggagaggaacggggucacaaggcgaaaccuuaggagaaaaguggaaaaagaaauuaaaucaguuaucccggaaagaguuugagcuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaaguccaacaguggaagaaagcagaacuauaagaguuuugaagaugguugagccauggcuaagaaacaaccaguuuugcauuaaaguauuaaacccuuacaugccaacugugauugagcaccuagaaaaacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuuuaaagagaaaguggacacuaggacacccaggcccaugccagggacaagaaagguuauggagauuacagcggaauggcuuuggagaacccugggaaggaacaaaaaacccagacugugcacaagagaagaguucacaaaaaaggucagaaccaacgcggcuaugggagcaguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcaucuaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7342 - RNA, 9873 nt, Artificial Sequence
  derived and/or modified CDS sequence (wt) from DENV-3__KF955464__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgauccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugagaaccuuaaauacacugucaucaucacagugcacacaggagaccaacaccaagugggaaaugacacgcagggagucacgguugagauaacuccccaggcaucaaccguugaagcugucuugcccgaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaaacauuuuugcggggcauuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccuaucaacauugaggcugaaccuccuuuuggggaaagcaacauagugauuggaauuggagacaaagccuuaaaaauuaacugguacaagaagggaagcucgauugggaagauguucgaggcgacugccagaggugcaaggcgcauggccaucuugggagacacagcuugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaggcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucucuuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaagagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacgacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccaacaccggaacuggaagaagaaauguucaaaaagcgaaaucuaacuauaauggaucuucauccugggucaggaaagacgcggaaauaucuuccagcuaucgucagagaagcaaucaagagacgccuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugauaauaauggaugaggcccauuucacagacccagccaguauagcggcuagaggguacauaucaacucguguaggaaugggagaggcagcugcaauuuucaugacagcaacacccccuggaacugcugaagcuuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggccgcgauaguagcagcuaaugaaaugggauuauuggaaaccacaaagagagaucuaggaaugucuaaagaaccagguguuguuucuccaaccagcuauuuagauguagacuugcacccagcaucagccuggacauuguacgccguggccacaacagugauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaaucuacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguugucccggaaagaguuugaccuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuauugcgcuggacugaaaaaaguuacagaagugcgaggguacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaggaugguugagccauggcuaagaaacaaccaguuuugcauuaaaguauuaaacccuuacaugccaaaugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggaucugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauucaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucggaggcagaccucgagaacccucaucugcuagagaagaaaaucacacaaugguuggaaaccaaaggaguggagagauuaaaaagaauggcuaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccagcccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuccuggacuacaugccuucgaugaagagauucaggaaggaggaggagucagagggagccauuugguaa

SEQ ID NO: 7343 - RNA, 9873 nt, Artificial Sequence
  derived and/or modified CDS sequence (wt) from DENV-3__FJ639731__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggagagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcaccucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggggaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauccaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaguacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacaccuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugcuucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagauggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcaaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauaccuggcaaaagcaaacccaaagaucuggcguucuaugggacguacccagccccccagaaacacagaaagcagaacuggaagagggggucuauaggaucaaacaacaaggaauuuuugggaaaacccaaguggggguuggggugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacaaagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuugagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguucgucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuuaacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaaccuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguuuugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuuuaaagagaaaguggacacuaggacacccaggcccaugccagggacaagaaagguuauggagauuacagcggaauggcuuuggagaacccugggaaggaacaaaaaacccagacugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaagcagaccucgagaacccucaucugcuagagaagaaaaucacacaaugguuggaaaccaaaggaguggagagauuaaaaagaauggccaucagcggggaugauugcguggugaaaccgauugaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuucuagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7344 - RNA, 9873 nt, Artificial Sequence
  derived and/or modified CDS sequence (wt) from DENV-3__HM181933__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccuuacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcaucgagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugugcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcuucaaccguugaagcugucuugccugaguauggaacccuugggcuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagcgcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuuaggaaaauuggagcuggacuuuaacuauugugaaggaacaacaguagucaucacagaaaacugugggacaagacgcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccguacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugaacgcacaauggcaaaagggagaagaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuggcccacagaacgagaaacgcccuggacaacuuggugaugcugcacacgucagaacauggcgguagggccuacaggcaugcaguagaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagauaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggccaaagccacucgugaagcucaaaaaagaacagcugcuggaauaaugaagaauccaacgguggacgggauaaugacaauagaccuagauccuguaauauacgauucaaaauucgaaaaacaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacggauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagagaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaucugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaccugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugacuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7345 - RNA, 9873 nt, Artificial Sequence
  derived and/or modified CDS sequence (wt) from DENV-3__JF295012__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacauguguacucucauagcuauggacuugggagagaugugugaugacacggucacuuauaaaugcccccucauugcugaaguggaaccugaagacauugacugcuggugcaaccuuacaucgacaugggugaccuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuauauaggcacuucccugacccagaaagugguuauuuuuauacuacuaaugcuggucacuccauccaugacaaugagaugcgugggaguagggaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacgggcuuggauuucaaugaaaugauuuuauugacaaugaaaaacaaagccuggaugguacauaggcaaugguucuuugaccuaccccuaccauggacaucaggagcuacaacagagacaccaacuuggaacaagaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugcuagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacauuaacaccacagcccauggagcuaaaauauucauggaaaacauggggaaaggcaaaaauagugacagcugaaacacaaaauuccucauucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaacuuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuccucucagggcaaauaacauggagagauauggcacacacacucauaaugauuggguccaacgcuuccgacaggaugggaaugggcguuaccuauuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucuaacacaauuuucacguugacuguugccuggagaacagccaccuugauuuuggccggaguuucgcuuuugccacugugccagucuucgagcaugaggaaaacagauuggcucccaaugacuguggcagcuaugggagucccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauagaaucaaacaacaaggaauuuuugggaaaacccaaguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguuggaaugggagaggcagccgcaaucuucaugacagcaacacccccuggaacagcugaugccuuuccucagagcaacgcuccaauucaagaugaagaaagggacauaccagaacgcucauggaauucaggcaaugaauggauuaccgacuucgcugggaaaacggugugguuugucccuagcauuaaagccggaaaugacauagcaaacugcuugcgaaaaaacgggaaaaaagucauucaacuuaguaggaagacuuuugacacagaauaucagaagacuaaacugaaugauugggacuuuguggugacaacugacauuucagaaaugggggccaauuuuaaagcagauagagugauugacccaagaagaugucucaagccaguaaucuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagacagaaaauggugcuuugauggagaacguaauaaucaaauuuuagaggagaacauggauguggaaaucuggacaaaggaaggagaaaggaaaaaacugagaccuagguggcuugaugcccgcacuuauucagaucccuuagcacucaaggaauuuaaggauuuugcagcuggcagaaagucaaucgcccucgaucuugugacagaaauaggaagagugccuucacacuuagcccacagaacgagaaacgcccuggacaacuuggugaugcugcacacgucagaacauggcgguagggccuacaggcaugcaguagaggaacuaccagaaacaauggaaacacuccuacucuugggacucaugaucuuacuaacagguggagcaaugcuuuucuugauaucagguaaagggauuggaaagacuucaauaggacucauuuguguuauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccaggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaauauggucauucccgaaggaagagucauagacuuaggcuguggaagaggaggcuggucauauuauugcgcaggacugaaaaaaguuacagaagugcgaggauacacaaaaggcggcccaggacacgaagaaccaguacccaugucuacauacggauggaacauagucaaguuaaugaguggaaaggauguguuuuaucuuccaccugaaaagugugacacccuauugugugacauuggagaaucuucaccaagcccaacaguggaagaaagcagaacuauaagaguuuugaagaugguugagccauggcuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaaggauaaaaaggaucaaggaggagcauaguucaacauggcacuaugaugaugaaaauccuuauaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagguugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgggaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccugaacacagacaauuagcgaacgccauauucaagcucacauaccaaaacaagguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaaaggguggcaugauuggcaacaggucccuuucugcucccaccacuuucaugaacugaucaugaaagacggaagaaaguuggugguucccugcagaccccaggacgaacuaauaggaagggcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7346 - RNA, 9873 nt, Artificial Sequence
  derived and/or modified CDS sequence (wt) from DENV-3__FJ898463__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacgguuacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucgacugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacauuaacaccacaaccuauggagcuaaaauacucauggaaaacguggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuucgagagguguacacccaacuaugugaccauaggcuaaugucggcagcuguuaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaauggguguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguucguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacucacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccaccacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaagucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggacaaccuugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuggcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7347 - RNA, 9873 nt, Artificial Sequence
  derived and/or modified CDS sequence (wt) from DENV-3__GQ868616__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacgguuacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucgacugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuaucgggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucaucacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacauuaacaccacaaccuauggagcuaaaauacucauggaaaacguggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuucgagagguguacacccaacuaugugaccauaggcuaaugucggcagcuguuaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaauggguguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguucguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacucacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagcccuagauccuguaauauaugauucaaaauuugaaaagcaacugggacaagucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacccagauggcaaugacagauacaacuccauuuggccagcagagagucuuuaaagagaaaguggacaccaggacacccagguccaugccaggaacaagaagggucauggggaucacaccggaguggcucuggagacccuugggaaggaacaaaaaacccagguuaugcccaagggaagaguuuacaaaaaaggucagaacuaacgcacccaugggcgccguuuucacagaggagacccaaugggccagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcccaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuggcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7348 - RNA, 9873 nt, Artificial Sequence
  derived and/or modified CDS sequence (wt) from DENV-3__GQ199887__SS-prME
acaucacucugucucaugaugauauugccagcagcacuugcuuuccacuugacuucacgagauggagagccgcgcaugauuguggggaagaaugaaagaggaaaaucucuacuuuuuaagacagccucuggaauuaacaugugcacacucauagccauggacuugggagaaaugugugaugacacggucacuuacaaaugcccccacauuaccgaaguggaaccugaagacauugacugcuggugcaaccuuacaucgacaugggugacuuauggaacgugcaaucaagcuggagagcacagacgcgacaagagaucaguggcguuagcuccccauguuggcaugggacuggauacacgcacccaaaccuggaugucggcugaaggagcuuggagacaagucgagaagguagagacaugggcccuuaggcacccaggguucaccauacuagcccuauuucuugcccauuauauaggcacuuccuugacccagaagguggucauuuucauacuacuaaugcuggucaccccauccaugacaaugagaugugugggaguaggaaacagagauuuuguggaagguuuaucaggagcuacguggguugacguggugcuugagcacggugggugugugacuaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcggucuugccugaggagcaggaccagaacuacguguguaagcauacauacguagacagaggcugggggaacgguugugguuuguuuggcaagggaagcuugguaacaugugcgaaauuucaaugccuggaaucaauagagggaaaaguggugcaauaugagaaccucaaauacaccgucaucauuacagugcacacaggagaccaacaccaggugggaaaugaaacgcagggagucacggcugagauaacaccucaggcaucaaccacugaagccaucuugccugaauaugguacccuugggcuagaaugcucaccacggacagguuuggauuucaaugaaaugaucuuacuaacaaugaagaacaaagcauggaugguacauagacaaugguucuuugaccuaccucuaccauggacaucaggagcuacaacagaaacaccaaccuggaacaggaaggagcuucuugugacauucaaaaacgcacaugcgaaaaaacaagaaguaguuguccuuggaucgcaagagggagcaaugcauacagcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucguuaaagucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgccuugaaaaucaacugguacaagaagggaagcucgauugggaagauguucgaggccacugccagaggugcaaggcgcauggccaucuugggagacacagccugggacuuuggaucagugggugguguucugaacucauugggcaaaauggugcaccaaauauuuggaagugcuuacacagcccuauucaguggagucucuugggugaugaaaauuggaauagguguccucuugacuuggauaggguugaauucaaaaaacacauccaugucauuuucaugcauugcgauaggaaucauuacacucuaucugggagccgugguacaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggaguaugcggaaucaggucaacaaccagaauggagaaucucuuguggaagcaaauagccaaugaacugaacuacauauuaugggaaaacaauaucaaauuaacgguaguugugggcgauacaauuggggucuuagagcaagggaaaagaacacuaacaccacaacccauggagcuaaaauauucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcauccuucauagaggugaaaaccugcacauggccaaaaucacacacccuuuggagcaauggugugcuagagagugacaugaucaucccaaagagucuagcugguccuauuucgcaacacaacuacaggcccggguaucacacccaaacggcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaauuagacccaucagugagaaagaagagaacaugguaaagucuuuagccucagcagggaguggaaagguggacaacuucacaaugggugucuuguguuuggcaauccucuuugaagaggugaugagaggaaaauuugggaagaaacacaugauugcagggguuuucuucacguucgugcuccuucucucggggcaaauaacauggagagacauggcgcacacacucauaaugauaggguccaacgccucugacaggaugggaaugggcgucacuuaccuagcuuuaauugcaacguuuaaaauccagccauucuuggcuuugggauuuuuccuaagaaaacugacaucuagagaaaauuuauuguuaggaguuggguuggcuauggcaacaacgcugcaacugccagaggacauugaacaaauggcaaauggaaucgcucuggggcucauggcucuuaaacugauaacacaauuugaaacauaccaauuauggacggcauuagucuccuuaacgugcucaaauacaauguuuacguugacuguugccuggagaacagccacccugauuuuggccggaguuucgcuuuuaccagugugccagucuucgagcaugaggaaaacagacuggcucccaaugacuguggcagcuaugggaguuccaccccuaccacuuuuuauuuuuagcuugaaagacacacucaaaaggagaagcuggccacugaaugagggggugauggcuguugggcuugugagcauucuggccaguucucuccuuaggaaugaugugcccauggcuggaccauuaguggccgggggcuugcugauagcgugcuacgucauaaccggcacgucagcagaccucacuguagaaaaagcagcggauguaacaugggaggaagaggcugagcaaacaggagugucccacaacuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcauacuuggcaaaagcaaacccaaagauccggcguucuaugggacguacccagccccccagagacacagaaagcagaacuggaagaaggggucuauaggaucaaacagcaaggaauccucgggaaaacccaaguagggguuggaguacagaaagaaggagucuuccacaccauguggcacgucacaagaggggcaguguugacacauaaugggaaaagacuggaaccaaacugggcuagcgugaaaaaagaucugauuucauacggaggaggauggagauugagugcacaauggcaaaagggggaggaggugcagguuaucgcuguagagccugggaagaacccaaagaacuuucaaaccaugccaggcacuuuucagacuacaacaggggaaauaggagcaauugcacuggauuuuaagccuggaacuucaggaucuccuaucauaaacagagagggaaagguagugggacuguauggcaauggagugguuacaaagaaugguggcuacgucagcggaauagcgcaaacaaaugcagaaccagauggaccgacaccagaguuggaagaagagauguucagaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuacaacuugauaauaauggaugaggcccauuucacagacccagccaguauagcggcuagaggguacauaucaacucguguaggaaugggagaggcagccgcaauuuucaugacagcaacaccuccuggaacagcugaugccuuuccucagagcaacgcuccaauucaagaugaagaaagggacauaccagaacgcucauggaacucaggcaaugaauggauuaccgacuucgcugggaaaacggugugguuugucccuagcauaaaagccggaaaugacauagcaaacugcuugcgaaaaaacgggaaaaaggucauucaacuuaguagaaagaccuuugacacagaauaucagaagacuaaacugaaugauugggacuucguggugacaacugacauuucagaaaugggggccaauuucaaagcagauagagugaucgacccaagaagaugucucaaaccagugaucuugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaucaugcucacuggacagaagcaaaaaugcugcuggacaacaucaacacaccagaagggauuauaccagcucucuuugaaccagaaagggagaagucagccgccauagacggugaauaccgccugaagggugaguccaggaagacuuucguggaacucaugaggaggggugaccuuccaguuugguuagcccauaaaguagcuucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagauccuuuagcacucaaggaauucaaggauuuugcggcuggcagaaagucaaucgcccuugaucuugugacagaaauaggaagagugccuucacacuuagcccacagaacgagaaacgcucuggacaaucuggugaugcugcauacgucagaacauggcgguagggccuacaggcaugcgguggaggaacuaccagaaacaauggaaacacuccuacucuugggacucaugauccuguugacagguggaguaaugcuuuucuugauaucagguaaagggauuggaaagacuucaauaggacucauuuguguaauugcuuccagcggcauguuguggauggccgaugucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggacuguuggaaacuacaaagagagauuuaggaaugucuaaagagccagguguuguuucuccaaccagcuauuuggauguggacuugcacccagcaucagccuggacauuguacgccguggccacuacaguaauaacaccaauguugagacauaccauagagaauucuacagcaaaugugucccuagcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacauuaugcuauuauagguccaggauugcaagcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuauuaaugagaacaucaugggccuugugugaagcucuaacccuagcuacaggaccaauaacaacacucugggaaggaucaccugggaaguuuuggaacaccacgauagcuguuucuauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaauccggaaucacugaaguggauagaacagaagccaaagaagggcugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaaguuacagaagugcgaggauacacaaaaggcgguccaggacacgaagaaccaguaccuaugucuacauauggauggaacauaguuaaguuaaugaguggaaaggauguguuuuaucuuccaccugaaaagugugauacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagacuacaaaggaaacauggaggaaugcuugugagaaauccacuuucacgaaacuccacgcacgaaauguacuggauauccaaugguacagguaacaucgucucuucagucaacaugguaucuagauugcuacugaacagauucacgaugacacacaggaggcccaccauagagagagauguggauuuaggagcaggaacucgacauguuaaugcggaaccagaaauacccaacauggaugucauuggggaaagaauaaaaaggaucaaggaggaacauaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugcccauggugacacagauggcaaugacagauacaaccccuuuuggccagcagagagucuuuaaagagaaaguggacaccaggacaccuaggcccaugccagggacaagaaagguuauggagaucacagcggaguggcucuggagaacccugggaaggaacaaaagacccagguuaugcacaagggaagaguucacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggauacauauuaagagacauuuccaagauacccggaggagcuauguaugcugaugacacagcugguugggacacaaggauaacagaagaugaccugcacaaugaggaaaagaucacacagcaaauggacccugaacacaggcaguuagcgaacgcuauauucaagcucacauaccaaaacaaaguggucaaaguucaacgaccgacuccaacgggcacgguaauggacaucauaucuaggaaagaccaaagaggcaguggacaggugggaacuuauggucugaauacauucaccaacauggaagcccaguuagucagacaaauggaaggagaaggugugcugucaaaggcagaccucgagaacccucaucugcuagagaagaaaauuacacaaugguuggaaaccaaaggaguggagagguuaaaaagaauggccauuagcggggaugauugcguagugaaaccaaucgaugacagguucgccaaugcccugcuugcucugaacgauaugggaaagguuaggaaagacauaccucaguggcagccaucaaagggauggcaugauuggcaacagguucccuucugcucccaccacuuucaugaauugaucaugaaagauggaagaaaguuggugguucccugcagaccccaagaugaauuaauaggaagagcaagaaucucucaaggagcgggauggagccuuagagaaacugcaugucuggggaaagccuaugcccaaauguggagucucauguauuuucacagaagagaucucagacuagcauccaacgccauauguucagcaguaccaguccauuggguccccacaaguagaacgacauggucuauucaugcucaccaucaguggaugacuacagaagacaugcuuacugucuggaacaggguguggauagaggauaauccauggauggaagacaaaacuccaguuacaacuugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucgaugaagagauucaggaaggaggaggagucagagggagccauuugguaa

SEQ ID NO: 7349 - RNA, 9873 nt, Artificial Sequence
  derived and/or modified CDS sequence (wt) from DENV-3__GQ199888__SS-prME
acaucgcucugucucaugaugauauugccagcagcacuugcuuuccacuugacuucacgagauggagagccgcgcaugauuguggggaagaaugaaagaggaaaaucucuacuuuuuaagacagccucuggaauuaacaugugcacacucauagccauggacuugggagaaaugugugaugacacggucacuuacaaaugcccccacauuaccgaaguggaaccugaagacauugacugcuggugcaaccuuacaucgacaugggugacuuauggaacgugcaaucaagcuggagagcacagacgcgacaagagaucaguggcguuagcuccccauguuggcaugggacuggauacacgcacccaaaccuggaugucggcugaaggagcuuggagacaagucgagaagguagagacaugggcccuuaggcacccaggguucaccauacuagcccuauuucuugcccauuauauaggcacuuccuugacccagaagguggucauuuucauacuacuaaugcuggucaccccauccaugacaaugagaugugugggaguaggaaacagagauuuuguggaagguuuaucaggagcuacguggguugacguggugcuugagcacggugggugugugacuaccauggcuaagaacaagcccacgcuggauauagagcuucagaagaccgaggccacccaacuggcgacccuaaggaagcuaugcauugaggggaaaauuaccaacauaacaacugacucaagaugcccuacccaaggggaagcggucuugccugaggagcaggaccagaacuacguguguaagcauacauacguagacagaggcugggggaacgguugugguuuguuuggcaagggaagcuugguaacaugugcgaaauuucaaugccuggaaucaauagagggaaaaguggugcaauaugagaaccucaaauacaccgucaucauuacagugcacacaggagaccaacaccaggugggaaaugaaacgcagggagucacggcugagauaacaccucaggcaucaaccacugaagccaucuugccugaauaugguacccuugggcuagaaugcucaccacggacagguuuggauuucaaugaaaugaucuuacuaacaaugaagaacaaagcauggaugguacauagacaaugguucuuugaccuaccucuaccauggacaucaggagcuacaacagaaacaccaaccuggaacaggaaggagcuucuugugacauucaaaaacgcacaugcgaaaaaacaagaaguaguuguccuuggaucgcaagagggagcaaugcauacagcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucguuaaagucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaacuggagacaacgccuugaaaaucaacugguacaagaagggaagcucgauugggaagauguucgaggccacugccagaggugcaaggcgcauggccaucuugggagacacagccugggacuuuggaucagugggugguguucugaacucauugggcaaaauggugcaccaaauauuuggaagugcuuacacagcccuauucaguggagucucuugggugaugaaaauuggaauagguguccucuugacuuggauaggguugaauucaaaaaacacauccaugucauuuucaugcauugcgauaggaaucauuacacucuaucugggagccgugguacaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggagugugcggaaucaggucaacaaccagaauggagaaucucuuguggaagcaaauagccaaugaacugaacuacauauuaugggaaaacaauaucaaauuaacgguaguugugggcgauacaauuggggucuuagagcaagggaaaagaacacuaacaccacaacccauggagcuaaaauauucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcauccuucauagaggugaaaaccugcacauggccaaaaucacacacucuuuggagcaauggugugcuagagagugacaugaucaucccaaagagucuagcugguccuauuucgcaacacaacuacaggcccggguaucacacccaaacggcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaauuagacccaucagugagaaagaagagaacaugguaaagucuuuagccucagcagggaguggaaagguggacaacuucacaaugggugucuuguguuuggcaauccucuuugaagaggugaugagaggaaaauuugggaagaaacacaugauugcagggguuuucuucacguucgugcuccuucucucggggcaaauaacauggagagacauggcgcacacacucauaaugauaggguccaacgccucugacaggaugggaaugggcgucacuuaccuagcuuuaauugcaacguuuaaaauccagccauucuuggcuuugggauuuuuccuaagaaaacugacaucuagagaaaauuuauuguuaggaguuggguuggcuauggcaacaacgcugcaacugccagaggacauugaacaaauggcaaauggaaucgcucuggggcucauggcucuuaaacugauaacacaauuugaaacauaccaauuauggacggcauuagucuccuuaacgugcucaaauacaauguuuacguugacuguugccuggagaacagccacccugauuuuggccggaguuucgcuuuuaccagugugccagucuucgagcaugaggaaaacagacuggcucccaaugacuguggcagcuaugggaguuccaccccuaccacuuuuuauuuuuagcuugaaagacacacucaaaaggagaagcuggccacugaaugagggggugauggcuguugggcuugugagcauucuggccaguucucuccuuaggaaugaugugcccauggcuggaccauuaguggccgggggcuugcugauagcgugcuacgucauaaccggcacgucagcagaccucacuguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcauacuuggcaaaagcaaacccaaagauccggcguucuaugggacguacccagccccccagagacacagaaagcagaacuggaagaaggggucuauaggaucaaacagcaaggaauccucgggaaaacccaaguagggguuggaguacagaaagaaggagucuuccacaccauguggcacgucacaagaggggcaguguugacacauaaugggaaaagacuggaaccaaacugggcuagcgugaaaaaagaucugauuucauacggaggaggauggagauugagugcacaauggcaaaagggggaggaggugcagguuaucgcuguagagccugggaagaacccaaagaacuuucaaaccaugccaggcacuuuucagacuacaacaggggaaauaggagcaaucgcacuggauuuuaagccuggaacuucaggaucuccuaucauaaacagagagggaaagguagugggacuguauggcaauggagugguuacaaagaaugguggcuacgucagcggaauagcgcaaacaaaugcagaaccagauggaccgacaccagaguuggaagaagagauguucagaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuacaacuugauaauaauggaugaggcccauuucacagacccagccaguauagcggcuagaggguacauaucaacucguguaggaaugggagaggcagccgcaauuuucaugacagcaacaccuccuggaacagcugaugccuuuccucagagcaacgcuccaauucaagaugaagaaagggacauaccagaacgcucauggaacucaggcaaugaauggauuaccgacuucgcugggaaaacggugugguuugucccuagcauaaaagccggaaaugacauagcaaacugcuugcgaaaaaacgggaaaaaggucauucaacuuaguagaaagaccuuugacacagaauaucagaagacuaaacugaaugauugggacuucguggugacaacugacauuucagaaaugggggccaauuucaaagcagauagagugaucgacccaagaagaugucucaaaccagugaucuugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaucaugcucacuggacagaagcaaaaaugcugcuggacaacaucaacacaccagaagggauuauaccagcucucuuugaaccagaaagggagaagucagccgccauagacggugaauaccgccugaagggugaguccaggaagacuuucguggaacucaugaggagaggugaccuuccaguuugguuagcccauaaaguagcuucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagauccuuuagcacucaaggaauucaaggauuuugcggcuggcagaaagucaaucgcccuugaucuugugacagaaauaggaagagugccuucacacuuagcccacagaacgagaaacgcucuggacaaucuggugaugcugcauacgucagaacauggcgguagggccuacaggcaugcgguggaggaacuaccagaaacaauggaaacacuccuacucuugggacucaugauccuguugacagguggagcaaugcuuuucuugauaucagguaaagggauuggaaagacuucaauaggacucauuuguguaauugcuuccagcggcauguuguggauggccgaugucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggacuguuggaaacuacaaagagagauuuaggaaugucuaaagagccagguguuguuucuccaaccagcuauuuggauguggacuugcacccagcaucagccuggacauuguacgccguggccacuacaguaauaacaccaauguugagacauaccauagagaauucuacagcaaaugugucccuagcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacauuaugcuauuauagguccaggauugcaagcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuauuaaugagaacaucaugggccuugugugaagcucuaacccuagcuacaggaccaauaacaacacucugggaaggaucaccugggaaguuuuggaacaccacgauagcuguuucuauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaauccggaaucacugaaguggauagaacagaagccaaagaagggcugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaaguuacagaagugcgaggauacacaaaaggcgguccaggacacgaagaaccaguaccuaugucuacauauggauggaacauaguuaaguuaaugaguggaaaggauguguuuuaucuuccaccugaaaagugugauacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagacuacaaaggaaacauggaggaaugcuugugagaaauccacuuucacgaaacuccacgcacgaaauguacuggauauccaaugguacagguaacaucgucucuucagucaacaugguaucuagauugcuacugaacagauucacgaugacacacaggaggcccaccauagagagagauguggauuuaggagcaggaacucgacauguuaaugcggaaccagaaauacccaacauggaugucauuggggaaagaauaaaaaggaucaaggaggaacauaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugcccauggugacacagauggcaaugacagauacaaccccuuuuggccagcagagagucuuuaaagagaaaguggacaccaggacaccuaggcccaugccagggacaagaaagguuauggagaucacagcggaguggcucuggagaacccugggaaggaacaaaagacccagguuaugcacaagggaagaguucacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuacaacaugaugggcaagagagagaagaaacuuggagaguuuggcaaagcaaaaggcaguagagcuauaugguacaugugguugggagcuagguaccuugaguucgaagcccuuggauucuuaaaugaagaccacugguucucgcgugaaaacucuuacaguggaguagaaggagaaggacugcacaagcuaggauacauauuaagagacauuuccaagauacccggaggagcuauguaugcugaugacacagcugguugggacacaaggauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauucaccaacauggaagcccaguuagucagacaaauggaaggagaagaugugcugucaaaggcagaccucgagaacccucaucugcuagagaagaaaauuacacaaugguuggaaaccaaaggaguggagagguuaaaaagaauggccauuagcggggaugauugcguagugaaaccaaucgaugacagguucgccaaugcccugcuugcucugaacgauaugggaaagguuaggaaagacauaccucaguggcagccaucaaagggauggcaugauuggcaacagguucccuucugcucccaccacuuucaugaauugaucaugaaagauggaagaaaguuggugguucccugcagaccccaagaugaauuaauaggaagagcaagaaucucucaaggagcgggauggagccuuagagaaacugcaugucuggggaaagccuaugcccaaauguggagucucauguauuuucacagaagagaucucagacuagcauccaacgccauauguucagcaguaccaguccauuggguccccacaaguagaacgacauggucuauucaugcucaccaucaguggaugacuacagaagacaugcuuacugucuggaacaggguguggauagaggauaauccauggauggaagacaaaacuccaguuacaacuugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucgaugaagagauucaggaaggaggaggagucagagggagccauuugguaa

SEQ ID NO: 7350 - RNA, 9873 nt, Artificial Sequence
  derived and/or modified CDS sequence (wt) from DENV-3__GQ252674__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaaaagaucaguggcguuagcuccucauguuggcaugggacuggacacacgcacccaaaccuggaugucggcugaaggagcuuggagacaagucgagaagguagagacaugggcccucaggcacccaggguucaccauacuagcccuauuucuugcccauuacauaggcacuuccuugacccagaagguggucauuuuuauacuacuaaugcuggucaccccauccaugacaaugagaugugugggaauaggaaacagagauuuuguggaaggucuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaaugguuguggcuuguuuggcaagggaagcuugguaacgugugcgaaauuucaaugccuggaaccaauagagggaaaaguggugcaauaugagaaccucaaauacaccgucaucauuacagugcacacaggagaccaacaccagguaggaaaugaaacgcagggagucacggcugagauaacaccucaggcaucaaccacugaagccaucuugccugaauauggaacccuugggcuagaaugcucaccacggacagguuuggacuuuaaugaaaugaucuuacuaacaaugaagaacaaagcauggaugguacauagacaaugguuuuuugaccuaccucuaccauggacaucaggagcuacaacagaaacgccaaccuggaacaggaaggagcuucuugugacguucaaaaacgcacaugcgaaaaaacaagaaguagucguccuuggaucgcaagagggagcaaugcauaccgcacugacaggagccacagaaauccaaaacucaggaggcacaagcauuuuugcggggcacuuaaaauguagacuuaagauggacaaauuggaacucaaggggaugagcuaugcaaugugcacaaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguuugaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucaucacacucuaucugggagcugugguacaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggagugugcggaauuaggucaacaaccagaauggagaaucucuuguggaagcaaauagccaaugaacugaacuacauauuaugggaaaauaauaucaaguuaacgguaguugugggcgauacaauuggggucuuagagcaaggaaaaagaacacuaacaccacaaccuauggagcuaaaauacucauggaaaacauggggaaaggcaaaaauagugacagcugaaacacaaaauuccuccuucauaauagacgggccaaacacaccggaguguccaagugccucaagagcauggaaugugugggagguggaagauuacggguucggagucuucacaaccaacauauggcugaaacuccgagauguguacacccaacuaugugaccauaggcuaaugucggcggccguuaaggaugagagggccguacacgccgacaugggcuauuggauagaaagucaaaagaauggaaguuggaagcuagaaaaagcaucccucauagaggugaaaaccugcacauggccaaaaucacacacucuuuggagcaauggugugcuagagagugacaugaucaucccaaagagucuagcugguccuauuucgcaacacaacuacaggccuggguaccacacccaaacagcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguucucuucacguuugugcuccuucucucagggcaaauaacauggagagacauggcgcacacacuaauaaugauuggguccaacgccucugacaggaugggaaugggcgucaccuaccuagcuuuaauugcaacauuuaaaauccagccauucuuggcuuugggauuuuuccuaagaaaacugacaucuagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacggcauuagucuccuuaacguguucaaauacaauucuuacguuaacuguugccuggagaacagccacccugauuuuggccggaguuucgcuuuuaccagugugccagucuucgagcaugaggaaaacagacuggcuuccaaugacaguggcagcuaugggaguuccaccccuaccacuuuuuauuuucagccugaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcagaccucacuguggaaaaugcggcagaugugacaugggaggaagaggccgagcaaacaggagugucccacaacuuaaugaucacaguugaugaugauggaacaaugagaauaaaagaugaugagacugagaacauccuaacagugcuuuuaaaaacggcauuacuaauaguaucaggcaucuuuccauacuccauaccugcaacauuguuggucuggcauaccuggcaaaagcaaacccaaagauccggcguucugugggacguacccagccccccagagacacagaaagcagaacuggaagaagggguuuauaggaucaaacagcaaggaauuuuugggaaaacccaaguagggguuggaguacagaaagaaggagucuuccacaccauguggcacgucacaagaggggcaguguugacacauaaugggaaaagacuggaaccaaacugggcuagugugaaaaaagaucugauuucauacggaggaggauggagauugagcgcgcaauggcaaaggggggaggaggugcagguuauugccguggagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguacggcaauggagugguuacaaagaaugguggcuacgucagcggaauagcgcaaacaaaugcagaaccagauggaccuacaccagaguuggaagaagagauguucaaaaagcgaaauuuaaccauaauggaucuucauccugggucaggaaagacacgaaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgcuugcugucaccaguuaggguuccaaauuauaacuugauaauaauggaugaggcccauuucacagacccagccaguauagcggccagaggguacauaucaacucguguuggaaugggagaggcagccgcaauuuucaugacagcaacgcccccuggaacagcugaugccuuuccccagagcaacgcuccaauucaagaugaagaaagggacauaccagaacgcucauggaauucaggcaaugaauggauuaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaauaccagucaccgcggcgagugcugcgcaaaggagaggaagaguugguaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugagccagaaagggagaagucagccgccauagacggugaguaccgccugaagggugaguccaggaagacuuucguggaacucaugaggaggggagaccuuccaguuugguuagcccauaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugacgcccgcacuuauucagaucccuuagcacucaaggaauuuaaggacuuugcggcuggcagaaagucaaucgcccuugaucuugugacagaaauaggaagagugccuucacaccuagcccacagaacgagaaacgcucuggacaaucugguaaugcugcauacuucagaacauggcgguagggccuacaggcaugcgguggaggaacuaccagaaacaauggaaacacucuuacucuugggacucaugauuuuguugacagguggagcaaugcuuuucuugauaucaggaaaagggauuggaaagacuucaauaggacucauuuguguaauugccuccagcggcauguuguggauggccgaaaucccacuccaguggaucgcgucagcuauaguccuggaguuuuuuaugaugguguugcuuauaccagaaccagaaaagcagagaaccccccaagacaaccaacucgcauauguugugauaggcauacuuacauuggcugcaauaauagcagccaaugaaaugggacuguuggaaacuacaaagagagauuuaggaaugucuaaggagccagguguuguuucuccaaccagcuauuuggauguggacuugcacccagcaucagccuggacauuguacgccguggccacuacaguaauaacaccaauguuaagacauacuauagagaacucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagccacaggaccaauaacaacacucugggaaggaucaccuggaaaguuuuggaacaccacgauagcuguuuccauggcgaacauuuuuagagggagcuauuuagcaggagcugggcuugcuuuuucuauuaugaaaucaguuggaacaggaaaaagaggaacagguucacaaggcgaaacuuuaggagaaaaauggaaaaagaaauuaaaccaauuaucccggaaagaguuugaccuuuacaagaaaucuggaaucacugaaguggauagaacagaagccaaagaaggauugaagagaggagaaauaacacaucaugccguguccagagguagcgcaaaacuucaaugguuuguggagagaaacauggucauucccgaaggaagagucauagacuugggcuguggaagaggaggcuggucauacuacugugcaggacugaaaaaagucacagaaguacgaggauacacaaaaggcgguccaggacacgaagaaccaguacccaugucuacauauggauggaacauaguuaaguuaaugaguggaaaggauguguuuuaucuuccaccugaaaagugugauacccuguugugugacauuggagaaucuucaccaagcccaacaguggaagaaagcagaaccauaagaguuuugaagaugguugaaccauggcuaaaaaacaaccaguuuugcauuaaaguauugaacccuuacaugccaacugugauugaacaccuagaaagauuacaaaggaaacauggaggaaugcuugugagaaauccacuuucacgaaacuccacgcacgaaauguacuggauaucuaauggcacagguaacauugucucuucagucaacaugguaucuagauugcuacugaacagguucacgaugacacacaggagaccuaccauagagaaagauguggauuuaggagcaggaacucgacauguuaaugcggaaccagaaacacccaacauggaugucauuggggaaagaauaaaaaggauuaaggaggagcacaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugccuauggugacacagauggcaaugacagauacaacuccauuuggccagcagagagucuuuaaagagaaaguggacaccaggacacccagguccaugccagggacaagaaagguuauggggaucacagcggaauggcucuggagaacccugggaaggaacaaaagacccagguuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugacaacucuuacaguggaguagaaggagaaggacugcacaagcuaggcuacauauuaagggacauuuccaagauacccggaggagcuauguaugcugacgacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacgggcacgguaauggacauuauaucuaggaaagaccaaagaggcaguggacaggugggaacuuauggucugaauacauucaccaacauggaaguccaguuagucagacaaauggaaggagaaggugugcugucaaaggcagaccucgagaacccucaucugccagagaagaaaaucacacaaugguuggaaaccaaaggaguggagagguuaaaaagaauggccauuagcggggaugauuguguagugaaaccaaucgaugacagguucgcuaaugcccugcuugcucugaacgauaugggaaagguucggaaagacauaccucaauggcagccaucaaagggauggcaugauuggcaacagguuccuuucugcucccaccacuuucaugaauugaucaugaaggauggaagaaaguuagugguucccuguagaccccaggacgaacuaauaggaagagcaagaaucucucaaggagcgggauggagccuuagagagaccgcaugucuggggaaagccuacgcucaaauguggagucucauguacuuucacagaagagaucucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaaaacaaaacuccaguuacaaccugggaaaauguuccauaucuagggaagagagaagaccaauggugcggaucacuuauuggucucaccuccagagcaaccugggcccagaacauacccacagcaauccaacaggugagaagccuuauaggcaaugaagaguuucuggauuacaugccuucaaugaagagauucaggaaggaggaggagucggaaggagccauuugguaa

SEQ ID NO: 7351 - RNA, 9873 nt, Artificial Sequence
  derived and/or modified CDS sequence (wt) from DENV-3__GQ199889__SS-prME
acaucgcucugucucaugaugauauugccagcagcacuugcuuuccacuugacuucacgagauggagagccgcgcaugauuguggggaagaaugaaagaggaaaaucucuacuuuuuaagacagccucuggaauuaacaugugcacacucauagccauggacuugggagaaaugugugaugacacggucacuuacaaaugcccccacauuaccgaaguggaaccugaagacauugacuguuggugcaaccuuacgucgacaugggugacuuauggaacgugcaaucaagcuggagagcacagacgcgacaagagaucaguggcguuagcuccccauguuggcaugggacuggauacacgcacccaaaccuggaugucggcugaaggagcuuggagacaagucgagaagguagagacaugggcccuuaggcacccaggguucaccauacuagcccuauuucuugcccauuacauaggcacuuccuugacccagaaagugguuauuuuuauacuacuaauacuggucacuccauccauggcaaugagaugcgugggaguaggaaacagagauuuuguggaaggucuaucgggagcuacguggguugacguggugcucgagcacggugggugugugacuaccauggcuaagaacaagcccacgcuggauauagagcuucagaagaccgaggccacccaacuggcgacccuaaggaaguuaugcauugaggggaaaauuaccaacauaacaacugacucaagauguccuacccaaggggaagcgaucuugccugaggagcaggaccagaacuacguguguaagcauacauacguagacagaggcugggggaacgguugugguuuguuuggcaagggaagcuugguaacaugugcgaaauuucaaugccuggaaucaauagagggaaaaguggugcaauaugagaaccucaaauacaccgucaucauuacagugcacacaggagaccaacaccaggugggaaaugaaacgcagggagucacggcugaaauaacaccucaggcaucaaccacugaagccaucuugccugaauaugguacccuugggcuagaaugcucaccacggacagguuuggauuucaaugaaaugaucuuacuaacaaugaagaacaaagcauggaugguacauagacaaugguucuuugaucuaccucuaccauggacaucaggagcuacaacagaaacaccaaccuggaacaggaaggagcuucuugugacauucaaaaacgcacaugcgaaaaaacaagaaguaguuguccuuggaucgcaagagggagcaaugcauacagcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaagucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgccuugaaaaucaacugguacaagaagggaagcucgauugggaagauguucgaggccacugccagaggugcaaggcgcauggccaucuugggagacacagccugggacuuuggaucagugggugguguucugaacucauugggcaaaauggugcaccaaauauuuggaagugcuuacacagcccuauucaguggagucucuugggugaugaaaauuggaauagguguccucuugacuuggauaggguugaauucaaaaaacacauccaugucauuuucaugcauugcgauaggaaucauuacacucuaucugggagccgugguacaagcugacacagggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggaguaugcggaaucaggucaacaaccagaauggagaaucucuuguggaagcaaauagccaaugaacugaacuacauauuaugggaaaacaauaucaaauuaacgguaguugugggcgauacaauuggggucuuagagcaagggaaaagaacacuaacaccacaacccauggagcuaaaauauucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuggaaaaagcauccuucauagaggugaaaaccugcacauggccaaaaucacacacucuuuggagcaauggugugcuagagagugacaugaucaucccaaagagucuagcugguccuauuucgcaacacaacuacaggcccggguaucacacccaaacggcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaauuagacccaucagugagaaagaagagaacaugguaaagucuuuagccucagcagggaguggaaagguggacaacuucacaaugggugucuuguguuuggcaauccucuuugaagaggugaugagaggaaaauuugggaaaaagcacaugauugcagggguuuucuucacguucgugcuccuucucucggggcaaauaacauggagagacauggcgcacacacucauaaugauaggguccaacgccucugacaggaugggaaugggcgucacuuaccuagcuuuaauugcaacguuuaaaauccagccauucuuggcuuugggauuuuuccuaagaaaacugacaucuagagaaaauuuauuguuaggaguuggguuggcuauggcaacaacgcugcaacugccagaggacauugaacaaauggcaaauggaaucgcucuggggcucauggcucuuaaacugauaacacaauuugaaacauaccaauuauggacggcauuaaucucccuaacgugcucaaauacaauguuuacguugacuguugccuggagaacagccacccugauuuuggccggaguuucgcuuuuaccagugugccagucuucgagcaugaggaaaacagacuggcucccaaugacuguggcagcuaugggaguuccaccccuaccacuuuuuauuuuuagcuugaaagacacacucaaaaggagaagcuggccacugaaugagggggugauggcuguugggcucgugagcauucuggccaguucucuccuuaggaaugaugugcccauggcuggaccauuaguggccgggggcaugcugauagcgugcuacgucauaaccggcacgucagcagaccucacuguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcauacuuggcaaaagcaaacccaaagauccggcguucuaugggacguaccuagccccccagagacacagaaagcagaacuggaagaaggggucuauaggaucaaacagcaaggaauccucgggaaaacccaaguagggguuggaguacagaaagaaggagucuuccacaccauguggcacgucacaagaggggcaguguugacacacaaugggaaaagacuggaaccaaacugggcuagcgugaaaaaagaucugauuucauacggaggaggauggagauugagugcacaauggcaaaagggggaggaggugcagguuaucgcuguagagccugggaagaacccaaagaacuuucaaaccaugccaggcacuuuucagacuacaacaggggaaauaggagcaauugcacuggauuuuaagccuggaacuucaggaucuccuaucauaaacagagagggaaagguagugggacuguauggcaauggagugguuacaaagaaugguggcuacgucagcggaauagcgcaaacaagugcagaaccagauggaccgacaccagaguuggaagaagagauguucagaaagcgaaaucuaacuauaauggaucuucauccugggucaggaaagacacggaaauaccuuccagcuaucguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuacaacuugauaauaauggaugaggcccauuucacagacccagccaguauagcggcuagaggguacauaucaacucguguaggaaugggagaggcagccgcaauuuucaugacagcaacaccuccuggaacagcugaugccuuuccucagagcaaugcuccaauucaagaugaagagagggacauaccagaacgcucauggaacucaggcaaugaauggaucaccgacuucgcugggaaaacggugugguuugucccuagcauaaaagccggaaaugacauagcgaacugcuugcgaaaaaacgggaaaaaggucauucaacuuaguagaaagaccuuugacacagaauaucagaagacuaaacugaaugauugggacuucguggugacaacugacauuucagaaaugggggccaauuucaaagcagauagagugaucgacccaagaagaugucucaaaccagugaucuugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugacgaagaucaugcucacuggacagaagcaaaaaugcugcuggacaacaucaacacaccagaagggauuauaccagcucucuuugaaccagaaagggagaagucagccgccauagacggugaauaccgccugaagggugaguccaggaagaccuucguggaacucaugaggaggggugaccucccaguuuggcuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagauccuuuagcacucaaggaauucaaggauuuugcggcuggcagaaagucaaucgcccuugaucuugugacagaaauaggaagagugccuucacacuuagcccacagaacgagaaacgcucuggacaaucuggugaugcugcauacgucagaacauggcgguagggcuuacaggcaugcgguggaggaacuaccagaaacaauggaaacacuccuacucuugggacucaugauccuguugacagguggagcaaugcuuuucuugauaucagguaaagggauuggaaagacuucaauaggacucauuuguguaauugcuuccagcggcauguuguggauggccgaugucccacuccaauggaucgcgucggcuauaguccuggaguuuuuuaugaugguguugcuuauaccagaaccagaaaagcagagaaccccccaggacaaccaacucgcauaugucgugauaggcauacuuacauuggcugcaauaauagcagccaaugaaaugggacuguuggaaacuacaaagagagaucuaggaaugucuaaagagccagguguuguuucuccaacuagcuauuuggauguggacuugcacccagcaucagccuggacauuguacgccguggccacuacaguaauaacaccaauguugagacauaccauagagaauucuacagcaaaugugucccuagcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacacuaugcuauuauaggcccaggauugcaagcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuucuauuaaugagaacaucaugggccuugugugaagcucuaacccuagcuacaggaccaauaacaacacucugggaaggaucaccugggaaguuuuggaacaccacgauagcuguuucuauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaauccggaaucacugaaguggauagaacagaagccaaagaagggcugaaaagaggagaaacaacacgucaugccguguccagaggcagcgcaaaacuucaaugguucguggagagaaacauggucauucccgaaggaagagucauagacuuaggcuguggaagaggaggcuggucauauuacugcgcaggacugaagaaaguuacagaagugcgaggauacacaaaaggcgguccaggacacgaagaaccaguaccuaugucuacauacggauggaacauagucaaguuaaugaguggaaaggauguguuuuaucuuccaccugaaaagugugacacccuauugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagauuacaaaggaaacauggaggaaugcuugugagaaauccacuuucacgaaacuccacgcacgaaauguacuggauauccaauggcacagguaacaucgucucuucagucaacaugguaucuagauugcuacugaacagauucacgaugacacacaggaggcccaccauagagagagauguggauuuaggagcaggaacucgacauguuaaugcggaaccagaaauacccaacauggaugucauuggggaaagaauaaaaaggaucaaggaggaacauaauucaacauggcacuaugaugacgaaaaccccuacaaaacgugggcuuaccauggauccuaugaagucaaagccacaggcucagccuccuccaugauaaauggaguugugaaacuccucacuaaaccaugggauguggugcccauggugacacagauggcaaugacagauacaaccccuuuuggccagcagagagucuuuaaagagaaaguggacaccaggacaccuaggcccaugccagggacaagaaagguuauggagaucacagcggaguggcucuggagaacccuaggaaggaacaaaagacccagguuaugcacaagggaagaguucacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggauacauauuaagagacauuuccaagauacccggaggagcuauguaugcugaugacacagcugguugggacacaaggauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaacacauuuaccaacauggaagcccaguuagucagacaaauggaaggagaaggugugcugucaaaggcagaccucgagaacccucaucugcuagagaagaaaauuacacaaugguuggaaaccaaaggaguggagagguuaaaaagaauggccauuagcggggaugauugcguagugaaaccaaucgaugauagguucgccaaugcccugcuugcucugaacgauaugggaaagguuaggaaagacauaccucaguggcagccaucaaaaggauggcaugauuggcaacagguucccuucugcucccaccacuuucaugaauugaucaugaaagauggaagaaaguuggugguucccugcagaccccaagaugaauuaauaggaagagcaagaaucucucaaggagcgggauggagccuuagagaaacugcaugucuggggaaagccuaugcccaaauguggagucucauguauuuucacagaagagaucucagacuagcauccaacgcuauauguucagcaguaccaguccauuggguccccacaaguagaacgacauggucuauucaugcucaccaucaguggaugacuacagaagacaugcuuacugucuggaacaggguguggauagaggauaauccauggauggaagacaaaacuccaguuacaacuugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucgaugaagagauucaggaaggaggaggagucagagggagccauuugguaa

SEQ ID NO: 7352 - RNA, 9873 nt, Artificial Sequence
  derived and/or modified CDS sequence (wt) from DENV-3__FJ882571__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaaaagaucaguggcguuagcuccucaugucggcaugggacuggacacacgcacccaaaccuggaugucggcugaaggagcuuggagacaagucgagaagguagagacaugggcccucaggcacccaggguucaccauacuagcucuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugauucaagauguccuacccaaggggaagcgguuuugccugaggagcaggaccagaacuacguguguaagcauacauacguagacagaggcugggggaacgguuguggcuuguuuggcaagggaagcuugguaacgugugcgaaauuucaaugccuggaaccaauagagggaaaaguggugcaauaugagaaccucaaauacaccgucaucauuacagugcacacaggagaccaacaccagguaggaaaugaaacgcagggagucacggcugagauaacaccucaggcaucaaccacugaagccaucuugccugaauauggaacccuugggcuagaaugcucaccacggacagguuuggauuucaaugaaaugaucuuacuaacaaugaagaacaaagcauggaugguacauagacaaugguuuuuugaccuaccucuaccauggacaucaggagcuacaacagaaacgccaaccuggaauaggaaggagcuucuugugacauucaaaaacgcacaugcgaaaaaacaagaaguaguuguccuuggaucgcaagagggagcaaugcauaccgcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucauuacacucuaucugggagcugugguacaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggagugugcggaauuaggucaacaaccagaauggagaaucucuuguggaagcaaauagccaaugaacugaacuacauauuaugggaaaacaauaucaaauuaacgguaguugugggcgauacaauuggggucuuagagcaaggaaaaagaacucuaacaccacaacccauggagcuaaaauacucauggaaaacguggggaaaggcaaaaauagugacagcugaaacacaaaauuccuccuucauaauagacgggccaaacacaccggaguguccaagugccucaagagcauggaaugugugggagguggaagauuacggguucggagucuucacaaccaacauauggcugaaacuccgagauguguacacccaacuaugugaccauaggcuaaugucggcagccgucaaggaugagagggccguacacgccgacaugggcuauuggauagaaagccaaaagaauggaaguuggaaacuagaaaaagcaucccucauagagguaaaaaccugcacauggccaaaaucacacacucuuuggagcaauggugugcuagagagugacaugaucaucccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcagggguucucuucacguuugugcuccuucucucagggcaaauaacauggagagacauggcgcacacacuaauaaugauuggguccaacgccucugacaggaugggaaugggcgucaccuaccuagcuuuaauugcaacauuuaaaauccagccauucuuggcuuugggauuuuuccuaagaaaacugacaucuagagaaaauuuauuguuaggaguugggcuggcuauggcaacaacgcuacaacugccagaggacauugaacaaauggcaaauggaaucgcucuggggcucauggcucuuaaacugauaacacaauuugaaacauaccaacuauggacggcauuagucuccuuaacguguucaaauacaauucuuacguugacuguugccuggagaacagccacccugauuuuggccggaguuucgcuuuuaccagugugccagucuucgagcaugaggaaaacagacuggcuuccaaugacaguggcagcuaugggaguuccaccccuaccacuuuuuauuuuuagcuugaaagacacacucaaaaggagaagcuggccacugaaugaaggggugauggcuguugggcuugugagcauccuggccaguucucuccuuagaaaugaugugcccauggcuggaccauuaguggccgggggcuugcugauagcgugcuacgucauaacuggcacgucagcagaccucauuguggaaaaagcagcagauguaacaugggaggaagaggcugagcaaacaggagugucccacaacuuaaugaucacaguugaugaugauggaacaaugagaauaaaagaugaugagacugagaacauccuaacagugcuuuuaaaaacagcauuacuaauaguaucaggcaucuuuccauacuccauacccgcaacauuguuggucuggcauacuuggcaaaagcaaacccaaagauccggcguucugugggacguacccagccccccagagacacagaaagcagaacuggaagaagggguuuauaggaucaaacagcaaggaauucuugggaaaacccaaguagggguuggaguacagaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguggagccugggaagaacccaaagaacuuucaaaccaugccaggcacuuuucaaacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacaaaugcagaaccagauggaccgacaccagaguuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgcuugcugucaccaguuaggguuccaaauuauaacuugauaauaauggaugaggcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauuaccgacuucgcugggaaaacggugugguuugucccuagcauuaaagccggaaaugacauagcaaacugcuugcggaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagaacgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugaaccagaaagggagaagucagccgccauagacggugaguaucgcuugaagggugaguccaggaagacuuucguggaacucaugaggaggggugaccuuccaguuugguuagcccauaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauuuaaggacuuugcggcuggcagaaagucaaucgcccuugaucuugugacagaaauaggaagagugccuucacaccuagcccacagaacgagaaacgcucuggacaauuuggugaugcugcacacgucagaacauggcgguagggccuacaggcaugcgguggaggaacuaccagaaacaauggaaacacucuuacucuuaggacucaugaucuuguugacagguggagcaaugcuuuucuugauaucaggaaaagggauuggaaagacuucaauaggacucauuuguguaauugccuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggacuguuggaaacuacaaagagagauuuaggaaugucuaaggagccagguguuguuucuccaaccagcuauuuggauguggacuugcacccagcaucagccuggacauuguacgccguggccacuacaguaauaacaccaauguuaagacauaccauagagaauuccacagcaaaugugucccuggcggcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacagguucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauacuacugugcaggacugaaaaaagucacagaagugcgaggauacacaaaaggcgguccaggacacgaagaaccaguaccuaugucuacauaugguuggaacauaguuaaguuaaugaguggaaaggauguguuuuaucuuccaccugaaaagugugauacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaacaugguaucuagauugcuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugcccauggugacacagauggcaaugacagauacaacuccauuuggccagcagagagucuucaaagagaaaguggacaccaggacacccaggcccaugccagggacaagaaagguuauggggaucacagcggaguggcucuggagaacccugggaaggaacaaaagacccagguuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagggaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugacaacucuuacaguggaguagaaggagaaggacugcacaagcuaggcuacauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacgggcacgguaauggacaucauaucuaggaaagaccaaagaggcagcggacaggugggaacuuauggucugaauacauucaccaacauggaaguccaguuagucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgccaaugcccugcuugcucugaacgacaugggaaagguucggaaagacauaccucaauggcagccaucaaagggaaugcaugauuggcaacagguuccuuucugcucccaccacuuucaugaauugaucaugaaagauggaagaaaguuagugguucccuguagaccccaggacgaacuaauaggaagagcaagaaucucucaaggagcgggauggagccuuagagaaaccgcaugucuggggaaagcuuacgcucaaauguggagucucauguauuuucacagaagagaucucagacuagcauccaacgccauauguucagcaguaccaguccacuggguccccacaaguagaacgacauggucuauucaugcucaccaucaguggaugacuacagaagacaugcuugcugucuggaacaggguguggaucgaggacaauccauggauggaagacaaaacuccagucacaacuugggaagauguuccauaucuagggaagagagaagaccaauggugcggaucacucaucggucucacuuccagagcaaccugggcccagaacauacucacagcaauucaacaggugagaagccuuauaggcaaugaagaguuucuggauuacaugccuucaaugaagagauucaggaaggaggaggagucggaaggagccauuugguaa

SEQ ID NO: 7353 - RNA, 9873 nt, Artificial Sequence
  derived and/or modified CDS sequence (wt) from DENV-3__FJ882572__SS-prME
acaucgcucugucucaugaugauauugccagcagcacuugcuuuccacuugacuucacgagauggagagccgcgcaugauuguggggaagaaugaaagaggaaaaucucuacuuuuuaagacagccucuggaauuaacaugugcacacucauagccauggacuugggagaaaugugugaugacacggucacuuacaaaugcccccacauuaccgaaguggaaccugaagacauugacuguuggugcaaccuuacgucgacaugggugacuuauggaacgugcaaucaagcuggagagcacagacgcgacaagagaucaguggcguuagcuccccauguuggcaugggacuggauacacgcacccaaaccuggaugucggcugaaggagcuuggagacaagucgagaagguagagacaugggcccuuaggcacccaggguucaccauacuagcccuauuucuugcccauuauauaggcacuuccuugacccagaagguggucauuuucauacuacuaaugcuggucacuccauccaugacaaugagaugugugggaguaggaaacagagauuuuguggaagguuuaucaggagcuacguggguugacguggugcuugagcacggugggugugugacuaccauggcuaagaacaagcccacgcuggauauagagcuucagaagaccgaggccacccaacuggcgacccuaaggaaguuaugcauugaggggaaaauuaccaacauaacaacugacucaagauguccuacccaaggggaagcggucuugccugaggagcaggaccagaacuacguguguaagcauacauacguagacagaggcugggggaacgguugugguuuguuuggcaagggaagcuugguaacaugugcgaaauuucaaugccuggaaucaauagagggaaaaguggugcaauaugagaaccucaaauacaccgucaucauuacagugcacacaggagaccaacaccaggugggaaaugaaacgcagggagucacggcugaaauaacaccucaggcaucaaccacugaagccaucuugccugaauaugguacccuugggcuagaaugcucaccacggacagguuuggauuucaaugaaaugaucuuacuaacaaugaagaacaaagcauggaugguacauagacaaugguucuuugaucuaccucuaccauggacaucaggagcuacaacagaaacaccaaccuggaacaggaaggagcuucuugugacauucaaaaacgcacaugcgaaaaaacaagaaguaguuguccuuggaucgcaagagggagcaaugcauacagcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaagucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgccuugaaaaucaacugguacaagaagggaagcucgauugggaagauguucgaggccacugccagaggugcaaggcgcauggccaucuugggagacacagccugggacuuuggaucagugggugguguucugaacucauugggcaaaauggugcaccaaauauuuggaagugcuuacacagcccuauucaguggagucucuugggugaugaaaauuggaauagguguccucuugacuuggauaggguugaauucaaaaaacacauccaugucauuuucaugcauugcgauaggaaucauuacacucuaucugggagccgugguacaagcugacacagggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggaguaugcggaaucaggucaacaaccagaauggagaaucucuuguggaagcaaauagccaaugaacugaacuacauauuaugggaaaacaauaucaaauuaacgguaguugugggcgauacaauuggggucuuagagcaagggaaaagaacacuaacaccacaacccauggagcuaaaauauucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuggaaaaagcauccuucauagaggugaaaaccugcacauggccaaaaucacacacucuuuggagcaauggugugcuagagagugacaugaucaucccaaagagucuagcugguccuauuucgcaacacaacuacaggcccggguaucacacccaaacggcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaauuagacccaucagugagaaagaagagaacaugguaaagucuuuagccucagcagggaguggaaagguggacaacuucacaaugggugucuuguguuuggcaauccucuuugaagaggugaugagaggaaaauuugggaaaaagcacaugauugcagggguuuucuucacguucgugcuccuucucucggggcaaauaacauggagagacauggcgcacacacucauaaugauaggguccaacgccucugacaggaugggaaugggcgucacuuaccuagcuuuaauugcaacguuuaaaauccagccauucuuggcuuugggauuuuuccuaagaaaacugacaucuagagaaaauuuauuguuaggaguuggguuggcuauggcaacaacgcugcaacugccagaggacauugaacaaauggcaaauggaaucgcucuggggcucauggcucuuaaacugauaacacaauuugaaacauaccaauuauggacggcauuaaucucccuaacgugcucaaauacaauguuuacguugacuguugccuggagaacagccacccugauuuuggccggaguuucgcuuuuaccagugugccagucuucgagcaugaggaaaacagacuggcucccaaugacuguggcagcuaugggaguuccaccccuaccacuuuuuauuuuuagcuugaaagacacacucaaaaggagaagcuggccacugaaugagggggugauggcuguugggcucgugagcauucuggccaguucucuccuuaggaaugaugugcccauggcuggaccauuaguggccgggggcaugcugauagcgugcuacgucauaaccggcacgucagcagaccucacuguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcauacuuggcaaaagcaaacccaaagauccggcguucuaugggacguaccuagccccccagagacacagaaagcagaacuggaagaaggggucuauaggaucaaacagcaaggaauccucgggaaaacccaaguagggguuggaguacagaaagaaggagucuuccacaccauguggcacgucacaagaggggcaguguugacacacaaugggaaaagacuggaaccaaacugggcuagcgugaaaaaagaucugauuucauacggaggaggauggagauugagugcacaauggcaaaagggggaggaggugcagguuaucgcuguagagccugggaagaacccaaagaacuuucaaaccaugccaggcacuuuucagacuacaacaggggaaauaggagcaauugcacuggauuuuaagccuggaacuucaggaucuccuaucauaaacagagagggaaagguagugggacuguauggcaauggagugguuacaaagaaugguggcuacgucagcggaauagcgcaaacaagugcagaaccagauggaccgacaccagaguuggaagaagagauguucagaaagcgaaaucuaacuauaauggaucuucauccugggucaggaaagacacggaaauaccuuccagcuaucguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuacaacuugauaauaauggaugaggcccauuucacagacccagccaguauagcggcuagaggguacauaucaacucguguaggaaugggagaggcagccgcaauuuucaugacagcaacaccuccuggaacagcugaugccuuuccucagagcaaugcuccaauucaagaugaagagagggacauaccagaacgcucauggaacucaggcaaugaauggaucaccgacuucgcugggaaaacggugugguuugucccuagcauaaaagccggaaaugacauagcgaacugcuugcgaaaaaacgggaaaaaggucauucaacuuaguagaaagaccuuugacacagaauaucagaagacuaaacugaaugauugggacuucguggugacaacugacauuucagaaaugggggccaauuucaaagcagauagagugaucgacccaagaagaugucucaaaccagugaucuugacagauggaccagagcgggugauccuggcuggaccaaugccagucaccgcggcgagcgcugcgcaaaggagagggagaguuggcaggaacccacaaaaagaaaaugaccaguacauauuuacgggccagccucucaacaaugaugaagaucaugcucacuggacagaagcaaaaaugcugcuggacaacaucaacacaccagaagggauuauaccagcucucuuugaaccagaaagggagaagucagccgccauagacggugaauaccgccugaagggugaguccaggaagacuuucguggaacucaugaggaggggugaccuuccaguuugguuagcccauaaaguagcuucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagauccuuuagcacucaaggaauucaaggauuuugcggcuggcagaaagucaaucgcccuugaucuugugacagaaauaggaagagugccuucacacuuagcccacagaacgagaaacgcucuggacaaucuggugaugcugcauacgucagaacauggcgguagggcuuacaggcaugcgguggaggaacuaccagaaacaauggaaacacuccuacucuugggacucaugauccuguugacagguggagcaaugcuuuucuugauaucagguaaagggauuggaaagacuucaauaggacucauuuguguaauugcuuccagcggcauguuguggauggccgaugucccacuccaauggaucgcgucggcuauaguccuggaguuuuuuaugaugguguugcuuauaccagaaccagaaaagcagagaaccccccaggacaaccaacucgcauaugucgugauaggcauacuuacauuggcugcaauaauagcagccaaugaaaugggacuguuggaaacuacaaagagagaucuaggaaugucuaaagagccagguguuguuucuccaacuagcuauuuggauguggacuugcacccagcaucagccuggacauuguacgccguggccacuacaguaauaacaccaauguugagacauaccauagagaauucuacagcaaaugugucccuagcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacacuaugcuauuauaggcccaggauugcaagcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuucuauuaaugagaacaucaugggccuugugugaagcucuaacccuagcuacaggaccaauaacaacacucugggaaggaucaccugggaaguuuuggaacaccacgauagcuguuucuauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaauccggaaucacugaaguggauagaacagaagccaaagaagggcugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaagaaaguuacagaagugcgaggauacacaaaaggcgguccaggacacgaagaaccaguaccuaugucuacauauggauggaacauaguuaaguuaaugaguggaaaggauguguuuuaucuuccaccugaaaagugugauacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagauuacaaaggaaacauggaggaaugcuugugagaaauccacuuucacgaaacuccacgcacgaaauguacuggauauccaauggcacagguaacaucgucucuucagucaacaugguaucuagauugcuacugaacagauucacgaugacacacaggaggcccaccauagagagagauguggauuuaggagcaggaacucgacauguuaaugcggaaccagaaauacccaacauggaugucauuggggaaagaauaaaaaggaucaaggaggaacauaauucaacauggcacuaugaugacgaaaaccccuacaaaacgugggcuuaccauggauccuaugaagucaaagccacaggcucagccuccuccaugauaaauggaguugugaaacuccucacuaaaccaugggauguggugcccauggugacacagauggcaaugacagauacaaccccuuuuggccagcagagagucuuuaaagagaaaguggacaccaggacaccuaggcccaugccagggacaagaaagguuauggagaucacagcggaguggcucuggagaacccuaggaaggaacaaaagacccagguuaugcacaagggaagaguucacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggauacauauuaagagacauuuccaagauacccggaggagcuauguaugcugaugacacagcugguugggacacaaggauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaacacauuuaccaacauggaagcccaguuagucagacaaauggaaggagaaggugugcugucaaaggcagaccucgagaacccucaucugcuagagaagaaaauuacacaaugguuggaaaccaaaggaguggagagguuaaaaagaauggccauuagcggggaugauugcguagugaaaccaaucgaugauagguucgccaaugcccugcuugcucugaacgauaugggaaagguuaggaaagacauaccucaguggcagccaucaaaaggauggcaugauuggcaacagguucccuucugcucccaccacuuucaugaauugaucaugaaagauggaagaaaguuggugguucccugcagaccccaagaugaauuaauaggaagagcaagaaucucucaaggagcgggauggagccuuagagaaacugcaugucuggggaaagccuaugcccaaauguggagucucauguauuuucacagaagagaucucagacuagcauccaacgcuauauguucagcaguaccaguccauuggguccccacaaguagaacgacauggucuauucaugcucaccaucaguggaugacuacagaagacaugcuuacugucuggaacaggguguggauagaggauaauccauggauggaagacaaaacuccaguuacaacuugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucgaugaagagauucaggaaggaggaggagucagagggagccauuugguaa

SEQ ID NO: 7354 - RNA, 9873 nt, Artificial Sequence
  derived and/or modified CDS sequence (wt) from DENV-3__FJ882573__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggauuugggagagaugugugaugacacggucacuuacaaaugcccccacauuaccgaaguggaaccugaagacauugacugcuggugcaaccucacaucaacaugggugacuuauggaacgugcaaucaagcuggagagcauagacgcgacaagagaucaguggcgcuagcuccccaugucggcaugggacuggacacacgaacccaaaccuggaugucggcugaaggagcuuggagacaagucgagaagguagagacaugggcccuuaggcacccaggguucaccauacuagcccuauuucucgcccauuacauaggcacuuccuugacccagaaggugguuauuuuuauauuauuaaugcuggucaccccauccaugacaaugagaugugugggaguaggaaacagagauuuuguggaagggcuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgguugugguuuguuuggcaaaggaagcuugguaacaugugcgaaauuucaaugccuggaaccaauagagggaaaaguggugcaauaugagaaccucaaauacaccgucaucauuacagugcacacaggagaccaacaccaggugggaaaugaaacgcaaggagucacggcugagauaacaccucaggcaucaaccacugaagccaucuugccugaauauggaacccuugggcuagaaugcucaccacggacagguuuggauuucaaugaaaugaucuuacuaacaaugaagaacaaagcauggaugguacauagacaaugguucuuugaccuaccucuaccaugggcaucaggagcuacaacagaaacaccaaccuggaacaggaaggagcuucuugugacauucaaaaacgcacaugcgaaaaaacaagaaguaguuguccuuggaucgcaagagggagcaaugcauaccgcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcacgggacaauacucauuaagguugaguacaaaggggaagacgcaccuugcaagauuccuuucuccacagaggauggacaagggaaagcucacaauggcagacugaucacagccaacccuguggugacuaagaaggaggagccugucaauauugaggcugaaccuccuuuuggggaaagcaauauaguaauuggaauuggagacaacgccuugaaaaucaacugguacaagaaggggagcucgauugggaagauguucgaggccacugccagaggugcaaggcgcauggccaucuugggagacacagcuugggacuuuggaucagugggugguguucugaacucauuaggcaaaauggugcaccaaauauuuggaagugcuuacacagcucuguucaguggagucucuugggugaugaaaauuggaauagguguucucuugacuuggauaggguugaauucaaaaaacacacccaugucauuuucaugcauugcgauaggaaucauuacacucuaucugggagcugugguacaagcugacauggggugugucauaaacuggaaaggcaaagaacucaaauguggaaguggaauuuucgucaccaaugagguccauaccuggacagagcaauacaaauuccaagcagacuccccaaaaagauuggcaacagccauugcaggcgcuugggagaauggaguguguggaauuaggucaacaaccagaauggagaaucucuuguggaagcaaauagccaaugaacugaacuacauauuaugggaaaacaauaucaaauuaacgguaguugugggcgauacaacuggggucuuagagcaagggaaaagaacacuaacaccacaacccauggagcuaaaauacucauggaaaacguggggaaaggcaaaaauagugacagcugaaacacaaaauuccucuuucauaauagacgggccaaacacaccggaguguccaagugcuucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuauuggauagaaagccaaaagaauggaaguuggaagcuagaaaaagcaucccucauagaggugaagaccugcacauggccaaaaucacacacucucuggaguaauggugugcuagagagugacaugaucaucccaaagagucuagcugguccuauuucacaacacaacuacaggcccggguaccacacccaaacggcaggacccuggcauuuaggaaaauuggagcuggacuucaacuauugugaaggaacaacaguugucaucacagaaaacugugggacaagaggcccaucacugagaacaacaacagugucagggaaguugauacacgaaugguguugccgcucgugcacacuuccuccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcagggguuuucuuuacguuugugcuccuucucucagggcaaauaacauggagagacauggcgcacacacuaauaaugauuggguccaacgccucugacaggaugggaaugggcgucaccuaccuagcucuaauugcaacauuuaaaauccagccauucuuggcuuugggauuuuuccuaagaaagcugacaucuagagaaaauuuauuguuaggaguuggguuggccauggcaacaacguuacaacugccagaggacauugaacaaauggcaaauggaaucgcucuggggcucauggcucuuaaacugauaacacaauuugaaacauaccaauuguggacggcauuagucuccuuaacguguucaaauacaauuuuuacguugacuguugcuuggagaacagccacccugauuuuggccggaguuucgcuuuuaccagugugccagucuucaagcaugaggaaaacagacuggcucccaaugacaguggcagcuaugggaguuccaccccuuccacuuuucauuuuuagcuugaaagacacacucaaaaggagaagcuggccacugaaugaaggggugauggcuguugggcuugugagcauucuggccagcucucuccuuagaaaugaugugcccauggcuggaccauuaguggccgggggcuugcugauagcgugcuacgucauaacuggcacgucagcagaccucacuguagaaaaagcagcagauguaacaugggaggaagaggcugagcagacaggagugucccacaacuuaaugaucacaguugaugaugauggaacaaugagaauaaaagaugaugagacugagaacauccuaacagugcucuuaaaaacagcauuacuaauaguaucaggcauuuuuccauacuccauacccgcaacauuguuggucuggcacacuuggcaaaagcaaacccaaagauccggcguuuuaugggacguacccagccccccagagacacagaaagcagaacuggaagaagggguuuauaggaucaaacagcaaggaauucuugggaaaacccaaguagggguuggaguacagaaagaaggagucuuccacaccauguggcacgucacaagaggggcaguguugacacauaaugggaaaagacuggaaccaaacugggcuagcgugaaaaaagauuugauuucauacggaggaggauggagacugagcgcacaauggcaaaagggggaggaggugcaggucauugccguagagccagggaagaacccaaagaacuuucaaaccaugccaggcacuuuucagacuacaacaggggaaauaggagcaauugcucuggauuucaagccuggaacuucaggaucuccuaucauaaacagagagggaaagguagugggacuguauggcaauggagugguuacaaagaaugguggcuaugucagcggaauagcgcaaacaaaugcagagccagauggaccgacaccagaguuggaagaagagauguucaaaaagcgaaaucuaaccauaauggaucuccauccugggucaggaaagacacggaaauaccuuccagcuaucgucagagaggcaaucaagagacguuuaagaacuuuaauuuuggcaccgacaagggugguugcagcugagauggaagaagcauugaaagggcucccaauaagguaccaaacaacagcaacaaaauccgaacacacaggaagagagauuguugaucuaaugugccacgcaacguucacaaugcgccugcugucaccaguuaggguuccaaauuacaacuugauaauaauggaugaggcccauuucacagacccagccaguauagcggcuagaggguacauaucaacucguguuggaaugggagaggcagccgcaauuuucaugacagcaacacccccuggaacagcugaugccuuuccucagagcaacgcuccaauucaagaugaagaaagggacauaccagaacgcucauggaauucaggcaaugaauggauuaccgacuucgcugggaaaacggugugguuugucccuagcauuaaagccggaaaugacauagcaaacugcuugcggaaaaacgggaaaaaggucauucaacuuaguaggaagacuuuugacacagaauaucagaaaacuaaacugaaugauugggacuucguggugacaacugauauuucagaaaugggggccaauuucaaagcagauagagugaucgacccaagaagaugucucaaaccagugaucuugacagauggaccagagcgggugauccuggccggaccaaugccagucaccgcggcgagugcugcgcaaaggagagggagaguuggcaggaacccacaaaaagaaaaugaccaguacauauuuacgggccagccucucaacaaugaugaagaccaugcucacuggacagaagcaaaaaugcugcuggacaacaucaacacaccagaagggauuauaccagcucucuuugaaccagaaagggagaagucagccgccauagacggugaguaucgccugaagggugaguccaggaagacuuucguggaacucaugaggaggggugaccuuccaguuugguuagcccauaaaguagcaucagaagggaucaaauauacagauagaaaauggugcuuugaugggcaacgcaauaaucaaauuuuagaggagaacauggauguggaaaucuggacaaaggaaggagaaaagaaaaaauugagaccuagguggcuugaugcccgcacuuauucagauccauuagcacucaaggaauucaaggacuuugcggcuggcagaaagucaaucgcccuugaucuugugacagaaauaggaagagugccuucacaccuagcccacagaacgagaaacgcucuggacaaucuggugaugcuacauacgucagaacauggcgguagggcuuacaggcaugcgguggaggaacuaccagaaacaauggaaacacuccuacucuugggacucaugaucuuguugacagguggagcaaugcuuuucuugauaucagguaaagggauuggaaagacuucaauaggacucauuuguguaauugcuuccagcggcaugcuguggauggccgaagucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaaugauagcagccaaugaaaugggacuguuggaaacuacaaagagagacuuaggaaugucuaaggagccagguguuguuucuccaaccagcuauuuggauguggacuugcacccagcaucagccuggacauuguacgccguggccacuacaguaauaacaccaauguuaagacacaccauagagaauucuacagcaaaugugucccuggcagcuauagccaaccaggcagugguccugauggguuuggacaaaggauggccaauaucaaaaauggacuuaggcgugccacuauuggcacuggguugcuauucacaagugaacccacugacucuaacugcggcaguacuuuugcuaaucacacauuaugcuaucauagguccaggacugcaagcaaaagccacccgugaagcucagaaaaggacagcugcuggaauaaugaagaauccaacgguggaugggauaaugacaauagaccuagauccuguaauauaugauucaaaauuugagaaacaacugggacagguuaugcuccugguuuugugugcaguucaacuuuuguuaaugagaacaucaugggccuugugugaagcuuugacccuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagagauaacacaucaugccguguccagagguagcgcaaaacuucaaugguuuguggagagaaacauggucguucccgaaggaagagucauagacuugggcuguggaagaggaggcuggucauauuacugugcaggacuaaaaaaagucacagaagugcgaggauacacaaaaggcgguccaggacacgaagaaccaguaccuaugucuacauauggauggaacauaguuaaguuaaugaguggaaaggauguguucuaucuuccaccugaaaagugugauacccuguugugugacauuggagaaucuucaccaagcccaacaguggaagagagcagaacuauaagaguuuugaagaugguugaaccauggcuaaaaaacaaccaguuuugcauuaaaguuuugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaauauggugucuagauugcuauugaacagguucacgaugacacacaggagacccaccauagagaaagauguggauuuaggagcaggaacucgacauguuaaugcggaaccagaaacacccaacauggaugucauuggggaaagaguaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuucucacuaaaccaugggauguggugcccauggugacacagauggcaaugacagacacaacuccauuuggccagcagagagucuuuaaagagaaaguggacaccaggacacccaggcccaugccagggacaagaaagguuauggagaucacagcggaguggcucuggagaacccugggaaggaacaaaagacccagguuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuauaacaugaugggcaagagagagaagaaacucggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucauacagcaaauggacccugaacacaggcaguuagcgaacgccauauuuaagcucacauaccaaaacaaaguggucaaaguucaacgaccgacuccaacgggcacgguaauggacauuauaucuagaaaagaccaaagaggcaguggacaagugggaacuuauggccugaauacauucaccaacauggaagcccaguuagucagacaaauggaaggagaaggugugcugacaaaggcagaccucgagaacccucaucugcuagagaagaaaauuacacaaugguuggaagccaaaggaguggagagguuaaaaagaauggccauuagcggggaugauuguguggugaaaccaaucgaugacagguucgcuaaugcccugcuugcucugaacgauaugggaaagguccggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaacugcaugucuggggaaagccuacgcccaaauguggagucuuauguauuuucacagaagagaucucagacuagcauccaacgccauauguucagcaguaccaguccacuggguucccacaagcagaacgacauggucuauucaugcucaccaucaguggaugacuacagaagacaugcuuacuguuuggaacaggguguggauagaggaaaauccauggauggaagacaaaacuccaguuacaacuugggaaaauguuccauaucuagggaagagagaagaccaaugguguggaucacuuauuggucucacuuccagagcaaccugggcccagaacauacccacagcaauucaacaggugagaagccuuauaggcaaugaagaguuccuggacuacaugccuucaaugaagagauucaggaaggaagaggagucggagggagccauuugguaa

SEQ ID NO: 7355 - RNA, 9873 nt, Artificial Sequence
  derived and/or modified CDS sequence (wt) from DENV-3__FJ898440__SS-prME
acaucgcucugucucaugaugauauugccagcugcacuugcuuuccacuugacuucacgagauggagagccgcgcaugauuguggggaagaaugaaagagggaaaucccuacuuuuuaagacagccucuggaauuaacaugugcacacucauagccauggacuugggagagaugugugaugacacggucacuuacaaaugcccccacauuaccgaaguggaaccugaagauauugacugcuggugcaaccuuacgucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagacuuuguggaaggucuaucaggagcuacguggguugacguggugcucgagcacggggggugugugacuaccauggcuaagaacaagcccacguuggauauagagcuucaaaagaccgaggccacccaacuggcgacccuaaggaagcuaugcauugaggggaaaauuaccaacauaacaacugacucaagaugucccacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaucacugaagccaucuugccugaauauggaacccuugggcuagaaugcucaccacggacagguuuggauuucaaugaaauggucuugcuaacaaugaagaacaaagcauggaugguacauagacaaugguuuuuugaccuaccucuaccauggacaucaggagcuacaacggaaacaccaaucuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacaaaaaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuguucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaagguaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauugggguccuagagcaaggaaaaagaacacuaacaccacaacccauggagcuaaaauacucauggaaaacguggggaaaggcaaaaauaguaacagcugaaacacaaaauuccucuuucauaauagacgggccaaacacaccagaguguccaagugccucaagagcauggaaugugugggagguggaagauuacggguucggaguuuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcuggucccauuucgcaacacaacuacaggcccggguaccacacccagacggcgggacccuggcauuuaggaaaauuagagcuggauuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcggggaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuacuuaccuagcuuuaauugcaacauuuaaaauccagccauucuuggcuuugggauuuuuccuaagaaaacugacaucuagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguucaaccucuaccacuuuuuauuuuuagcuugaaagacacacucaaaaggagaaguuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggccgagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggacguacccagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccugggacuucaggaucuccuaucauaaacagagagggaaagguagugggacuguauggcaauggaguggucacaaagaaugguggcuacgucagcggaauagcgcaaacgaaugcagaaccagauggaccgacaccagaauuggaagaagagauguucaaaaagcgaaaucuaaccauuauggaucuucauccugggucaggaaagacacggaaauaccuuccagcuauuguuagagaggcaaucaagagacguuuaagaacccuaauuuuggcaccgacaagggugguugcagcugagauggaagaagcauugaaagggcucccaauaagguaccaaacaacagcaacaaaaucugaacacacaggaagagagauuguugaucuaaugugucacgcaacguucacaaugcgucugcugucaccaguuaggguuccaaacuauaacuugauaauaauggaugaagcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucaaaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugccgcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaaggaaucaaauacacagauagaaaauggugcuuugauggacaacgaaauaaucaaauuuuagaggagaacauggauguggaaauuuggacaaaggaaggagaaaagaaaaaauugagaccuagguggcuugaugcccgcacuuauucagaucccuuagcacucaaggaauuuaaggacuuugcggcuggcagaaaaucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagaaagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaguuaaaucaauuaucccggaaagaguuugaccuuuacaagaaaucuggaaucaccgagguggauagaacggaagccaaagaaggguuaaaaagaggagaaauaacacaucaugccguguccagagguagcgcaaaacuccaaugguucguggagagaaacauggucauucccgaaggaagaguuauagacuugggcuguggaagaggagguuggucauauuacugugcaggacugaaaaaagucacagaagugcgaggauacacgaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagauuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccucuaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccaggcuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaguugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaaugaacccugaacacaggcaguuagcgaacgcuauauuuaagcucacauaccaaaacaaaguggucaaaguucaacgaccgacuccaacaggcacaguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccggagaagaaaauuacacaaugguuggaaaccaaaggaguggagagguuaaaaagaauggccauuagcggggaugauugcguagugaaaccaauugaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccaguuacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagguuuaggaaggaggaggagucggagggagccauuugguaa

SEQ ID NO: 7356 - RNA, 9873 nt, Artificial Sequence
  derived and/or modified CDS sequence (wt) from DENV-3__FJ898441__SS-prME
acaucgcucugucucaugaugauauugccagcagcacuugcuuuccacuugacuucacgagauggagagccgcgcaugaucguggggaagaaugaaagagggaaaucccuacuuuuuaagacagccucuggaauuaacaugugcacacucauagccauggacuuaggagagaugugugaugacacggucacuuacaaaugcccccacauuaccgaaguggaacccgaagauauugacugcuggugcaaccuuacgucaacaugggugacuuauggaacgugcaaucaagcuggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccacuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagcccacauuggauauagagcuucaaaagaccgaggccacccaacuggcgacccugaggaagcuaugcauugaggggaaaauuaccaacauaacaacugacucaagaugccccacccaaggggaagcgguuuugccugaggagcaggaccagaacuacguguguaagcauacauacguggacagaggcugggggaacggaugugguuuguuuggcaagggaagcuugguaacaugugcgaaauuucaaugccuggaaccaauagagggaaaaauggugcaauaugagaaccucaaauacaccgucaucaucacagugcacacaggagaccaacaccaggugggaaaugaaacgcagggagucacggcugagauaacaccucaggcaucaaucacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaaccauuuuugcggggcacuuaaaauguagacuuaaaauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacaaaaaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaguauuuggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaagguaaagaacuuaaauguggaaguggaaucuucgucaccaacgagguccauaccuggacagagcaauacaaauuccaagcagacuccccaaaaagacuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaaccuauggaguuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauauggcugaaacuccgagagguguacacccaacuaugugaccauaggcuaaugucggcagccgucaaggaugagagggccguacacgccgacaugggcuauuggauagaaagccaaaagaauggaaguuggaaacuagaaaaagcaucccucauagaggugaaaaccugcacauggccaaaaucacauacccuuuggaguaauggugugcuagagagugacaugaucaucccaaagagccuagcuggucccauuucgcaacacaacuacaggcccggguaccacacccagacggcgggacccuggcauuuaggaaaauuagagcuggauuucaacuauugugaaggaacaacaguugucaucacagaaaacugugggacaagaggcccaucauugagaacaacaacagugucagggaaguuaauacacgaaugguguugccgcucgugcacacucccuccccugcgauacaugggagaagacgguuguugguauggcauggaaaucagacccaucagugagaaagaagagaacaugguaaagucuuuggucucagcggggaguggaaagguggauaacuucacaaugggugucuuguguuuggcaauccucuuugaagaggugaugagaggaaaauuugggaagaaacacaugauuguggggguuuucuucacguuugugcuccuucucucagggcaaauaacauggagagacauggcgcacacacuaauaaugauuggguccaacgcaucugacaggaugggaaugggcguuaccuaccuagccuuaauugcaacauuuaaaauccagccauucuuggcuuugggauuuuuccuaagaaaacugacauccagagaaaauuuauuguuaggaguugggcuggcuauggcaacaacguuacaacugccagcggacauugaacaaauggcaaauggaaucgcucuggggcuuauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgaguaugaggaaaacagacuggcuuccaaugacaguggcagcuaugggaguucaaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggccgagcaaacaggagugucccacaacuuaaugaucacaguugaugacgauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcgcaauggcaaaagggggaggaggugcaggucauugccguagagccugggaagaacccaaagaacuuucaaaccaugccaggcacuuuucagacuacaacaggggaaauaggagcaauugcacuggauuucaagccugggacuucaggaucuccuaucauaaacagagagggaaagguagugggacuguauggcaauggaguggucacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauaaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugagucuaggaagacuuucguggaacucaugaggaggggcgaccuuccagucugguuagcccauaaaguagcaucagaagggaucaaauauacagauagaaaauggugcuuugauggacaacgaaauaaucaaaucuuagaggagaacauggauguggaaauuuggacaaaagaaggagaaaagaaaaaauugagaccuagguggcuugaugcccgcacuuauucagaucccuuagcacucaaggaauuuaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagaaagauuuaggaaugucuaaggagccagguguuguuucuucaaccagcuauuuagauguggacuugcacccagcaucagccuggacauuguacgccguggccacuacaguaauaacaccaauguuaagacauaccauagagaauucuacagcaaaugugucccuggcagccauagccaaccaggcagugguccugauggguuuggacaaaggauggccaauaucaaaaauggacuuaggaguaccccuacuggcauuggguugcuacucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugccuuuucuauuaugaaaucaguuggaacaggaaaaagaggaacaggcucacaaggugaaacuuuaggagaaaaauggaaaaagaaguuaaaucaauuaucccggaaagaguuugaccuuuacaagaaaucuggaauuaccgagguggauagaacggaagccaaagaaggguuaaaaagaggagaaauaacacaucaugccguguccagagguagcgcaaaacuccaaugguucguggagagaaacauggucauucccgaaggaagagucauagacuugggcuguggaagaggagguuggucauauuacugugcaggacugaaaaaagucacagaagugcgaggauacacaaaaggcgguccaggacacgaagaaccaguaccuauguccacauauggauggaacauaguuaaguuaaugacuggaaaggauguguuuuaucuuccaccugaaaagugugauacccugcugugugacauuggagaaucuucaccaagcccaacaguggaagaaagcagaacuauaagaguuuugaagaugguugaaccauggcuaaagaacaaccaauuuuguaucaaaguauugaacccguacaugccaacugugauugagcaccuagaaagauuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagagagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaagguuauggggaucacagcggaguggcucuggagaacccugggaaggaacaaaaaacccaggcuaugcacaagggaggaguuuacaaaaaagguuagaacuaacgcagccaugggcgccguuuucacagaggagaaccaaugggacagcgcgaaagcugcuguugaggaugaggauuuuuggaaacuuguggacagagaacgugaacuccacaaguugggcaaguguggaagcuguguuuacaacaugaugggcaagagagagaagaaacuuggagaguuuggcaaagcgaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccacgauacccggaggagcaauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggaacaguaauggacaucauaucuaggaaagaccaaagaggcagugggcagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaauugaugauagguucgcuaaugcccugcucgcucugaacgauaugggaaagguucggaaagauauaccucaauggcagccaucaaagggauggcaugauuggcaacagguuccuuucugcucccaccacuuucaugaauugaucaugaaagauggaagaaaguuggugguucccugcagaccccaggacgaauuaauaggaagagcaagaaucucucaaggagcgggauggagccuuagagaaaccgcauguuuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagguuuaggaaggaggaggagucggagggagccauuugguaa

SEQ ID NO: 7357 - RNA, 9873 nt, Artificial Sequence
  derived and/or modified CDS sequence (wt) from DENV-3__FJ898442__SS-prME
acaucgcucugucucaugaugauauugccagcagcacuugcuuuccacuugacuucacgagauggagagccgcgcaugaucguggggaagaaugaaagagggaaaucccuacuuuuuaagacagccucuggaauuaacaugugcacacucauagccauggacuuaggagagaugugugaugacacggucacuuacaaaugcccccacauuaccgaaguggaacccgaagauauugacugcuggugcaaccuuacgucaacaugggugacuuauggaacgugcaaucaagcuggagagcacagacgcgacaagagaucaguggcguuagcuccccaugucggcaugggacuggacacacgcacccaaaccuggaugucggcugaaggagccuggaggcaagucgagaagguagagacaugggcccuuaggcacccaggguucaccauacuagcccuauuucuugcccacuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagcccacguuggauauagagcuucaaaagaccgaggccacccaacuggcgacccugaggaagcuaugcauugaggggaaaauuaccaacauaacaacugacucaagaugccccacccaaggggaagcgguuuugccugaggagcaggaccagaacuacguguguaagcauacauacguggacagaggcugggggaacggaugugguuuguuuggcaagggaagcuugguaacaugugcgaaauuucaaugccuggaaccaauagagggaaaaauggugcaauaugagaaccucaaauacaccgucaucaucacagugcacacaggagaccaacaccaggugggaaaugaaacgcagggagucacagcugagauaacaccucaggcaucaaucacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaaccauuuuugcggggcacuuaaaauguagacuuaaaauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcaggcugauuacagccaacccaguggugacaaaaaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaguauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaagguaaagaacucaaauguggaaguggaaucuucgucaccaacgagguccauaccuggacagagcaauacaaauuccaagcagacuccccaaaaagacuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggaguuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauauggcugaaacuccgagagguguacacccaacuaugugaccauaggcuaaugucggcagccgucaaggaugagagggccguacacgccgacaugggcuauuggauagaaagccaaaagaauggaaguuggaaacuagaaaaagcaucccucauagaggugaaaaccugcacauggccaaaaucacauacccuuuggaguaauggugugcuagagagugacaugaucaucccaaggagccuagcuggucccauuucgcaacacaacuacaggcccggguaccacacccagacggcgggacccuggcauuuaggaaaauuagagcuggauuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguuguugguauggcauggaaaucagacccaucagugagaaagaagagaacaugguaaagucuuuggucucagcggggaguggaaagguggauaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagccuuaauugcaacauuuaaaauccagccauucuuggcuuugggauuuuuccuaagaaaacugacauccagagaaaauuuauuguuaggaguugggcuggcuauggcaacaacguuacaacugccagcggacauugaacaaauggcaaauggaaucgcucuggggcuuauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgaguaugaggaaaacagacuggcuuccaaugacaguggcagcuaugggaguucaaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggccgagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcgcaauggcaaaagggggaggaggugcaggucauugccguagagccugggaagaacccaaagaacuuucaaaccaugccaggcacuuuucagacuacaacaggggaaauaggagcaauugcgcuggauuucaagccugggacuucaggaucuccuaucauaaacagagagggaaagguagugggacuguauggcaauggaguggucacaaagaaugguggcuacgucagcggaauagcgcaaacgaaugcagaaccagauggaccgacaccagaauuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauaaaagccggaaaugacauagcaaacugcuugcgaaaaaacggaaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugagucuaggaagacuuucguggaacucaugaggaggggcgaccuuccagucugguuagcccauaaaguagcaucagaagggaucaaauauacagauagaaaauggugcuuugauggacaacgaaauaaucaaaucuuagaggagaacauggauguggaaauuuggacaaaagaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagaaagauuuaggaaugucuaaggagccagguguuguuucuucaaccagcuauuuagauguggacuugcacccagcaucagccuggacauuguacgccguggccacuacaguaauaacaccaauguuaagacauaccauagagaauucuacagcaaaugugucccuggcagccauagccaaccaggcagugguccugauggguuuggacaaaggauggccaauaucaaaaauggacuuaggaguaccccuacuggcauuggguugcuacucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugccuuuucuauuaugaaaucaguuggaacaggaaaaagaggaacaggcucacaaggugaaacuuuaggagaaaaauggaaaaagaaguuaaaucaauuaucccggaaagaguuugaccuuuacaagaaaucuggaauuaccgagguggauagaacggaagccaaagaaggguuaaaaagaggagaaauaacacaucaugccguguccagagguagcgcaaaacuccaaugguucguggagagaaacauggucauucccgaaggaagagucauagacuugggcuguggaagaggagguuggucauauuacugugcaggauugaaaaaagucacagaagugcgaggauacacaaaaggcgguccaggacacgaagaaccaguaccuauguccacauauggauggaacauaguuaaguuaaugacuggaaaggauguguuuuaucuuccaccugaaaagugugauacccugcugugugacauuggagaaucuucaccaagcccaacaguggaagaaagcagaacuauaagaguuuugaagaugguugaaccauggcuaaagaacaaccaguuuuguaucaaaguauugaacccuuacaugccaacugugauugagcaucuagaaagauuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagagagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaagguuauggggaucacagcggaguggcucuggagaacccugggaaggaacaaaaaacccaggcuaugcacaagggaggaguuuacaaaaaaggucagaacuaacgcagccaugggcgccguuuucacagaggagaaccaaugggacagcgcgaaagcugcuguugaggaugaggaauuuuggaaacuuguggacagagaacgugaacuccacaaguugggcaaguguggaagcuguguuuacaacaugaugggcaagagagagaagaaacuuggagaguuuggcaaagcgaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccacgauacccggaggagcaauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggaacaguaauggacaucauaucuaggaaagaccaaagaggcagugggcagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaauugaugauagguucgcuaaugcccugcucgcucugaacgauaugggaaagguccggaaagauauaccucaauggcagccaucaaagggauggcaugauuggcaacagguuccuuucugcucccaccacuuucaugaauugaucaugaaagauggaagaaaguuggugguucccugcagaccccaggacgaauuaauaggaagagcaagaaucucucaaggagcgggauggagccuuagagaaaccgcauguuuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaaaacaugcuuacugucuggaacaggguguggaucgaggacaauccauggauggaagacaaaaccccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagguuuaggaaagaggaggagucggagggagccauuugguaa

SEQ ID NO: 7358 - RNA, 9873 nt, Artificial Sequence
  derived and/or modified CDS sequence (wt) from DENV-3__FJ882575__SS-prME
acaucgcucugucucaugaugauauugccagcaacacuugcuuuccacuugacuucacgagauggagagccgcgcaugauuguggggaagaaugaaagaggaaaaucccuacuuuuuaagacagccucuggaauuaacaugugcacacucauagcuauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccaauagagggaaaaguggugcaauaugagaaccucaaauacaccgucaucauuacagugcacacaggagaccaacaccaggugggaaaugaaacgcagggagucacggcugagauaacaccucaggcaucaaccacugaagccaucuugccugaauauggaacccuugggcuagaaugcucaccacggacagguuuagauuucaaugaaaugaucuuacuaacaaugaagaacaaagcauggaugguacauagacaaugguuuuuugaccuaccucuaccauggacaucaggagcuacaacagaaacaccaaccuggaacaggaaggagcuucuugugacauucaaaaacgcacaugcgaaaaaacaagaaguaguuguccuuggaucgcaagagggagcaaugcauaccgcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgcuuugaaaaucaacugguacaagaaaggaagcucuauugggaagauguucgaggccacugccagaggugcaaggcgcauggccaucuugggagacacagcuugggacuuuggaucagugggugguauucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucauuacacucuaucugggagcugugguacaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggagugugcggaauuaggucaacaaccagaauggagaaucucuuguggaagcaaauagccaaugaacugaacuacauauuaugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacacacucuuuggaguaauggcgugcuagagagugacaugaucaucccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaccuagcuuuaauugcaacauuuaaaauccagccauucuuggcuuugggauuuuuccuaagaaaacugacaucuagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacggcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccccuaccacuuuuuauuuuuagcuugaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcagaccucacuguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggcaucuuuccauacuccauacccgcaacauuguuggucuggcauacuuggcaaaagcaaacccaaagauccggcguucuaugggacguacccagccccccagagacacagaaagcagaacuggaagaaggggucuacaggaucaaacagcaaggaauucuugggaaaacccaaguagggguuggaguacagaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagaggggaagguagugggacuguauggcaauggagugguuacaaagaaugguggcuacguuagcggaauagcgcaaacaaaugcagaaccagauggaccgacaccagaguuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgcuugcugucaccaguuaggguuccaaauuauaacuugauaauaauggaugaggcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauuaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugaaccagaaagggagaagucagccgccauagacggugaguaucgccugaagggugaguccaggaagacuuucguggaacucaugaggaggggugaccuuccaguuugguuagcccauaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcauacgucagaacauggcgguagggccuacaggcaugcgguggaggaacuaccagaaacaauggaaacacuccuacucuugggacucaugaucuuguugacagguggagcaaugcuuuucuugauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggacuguuggaaacuacaaagagagauuuaggaaugucuaaggagccagguguuguuucuccaaccagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuaugucuacauauggauggaacauaguuaaguuaaugaguggaaaggauguguuuuaucuuccaccugaaaagugugauacccuguugugugacauuggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacggguaacauugucucuucagucaacaugguaucuagauugcuacugaacagguucacgaugacacacaggagacccaccauagagaaagauguggauuuaggagcaggaacucgacauguugaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggcccaugccagggacaagaaagguuauggggaucacagcggaguggcuuuggagaacccugggaaggaacaaaagacccagguuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagagaacgugaacuccacaaauuggguaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauucaccaacauggaagcccaguuagucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcuugcucugaacgauaugggaaagguccggaaagacauaccucaauggcaaccaucaaagggauggcaugauuggcaacagguuccuuucugcucccaccacuuucaugaauugaucaugaaagauggaagaaaguuggugguucccugcagaccccaagacgaacuaauaggaagagcaagaaucucucaaggagcgggauggagccuuagagaaaccgcaugucuggggaaagccuacgcucaaauguggagucucauguauuuucacagaagagaucucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7359 - RNA, 9873 nt, Artificial Sequence
  derived and/or modified CDS sequence (wt) from DENV-3__GQ199886__SS-prME
acaucgcucugucuuaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgaaaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgaccuuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucauuaucacagugcacacaggagaccaacaccaggugggaaaugaaacgcagggagucacggcugagauaacaccucaggcaucaaccacugaagccaucuugccggaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuucguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgcccugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauuuggaagugcuuacacagcccuauucaguggagucucuuggguaaugaaaauuggaauaggaguucucuugacuuggaugggguugaauucaaaaaacacauccaugucauuuucaugcaucgcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagcuauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggagucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuaguaucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuugauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagccugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacgguugaugaugauggaacaaugagaauaaaagaugaugagacugagaauauccuaacagugcuuuugaaaacagcauuacuaauaguaucaggaaucuuuccauacuccauacccgcaacauuguuggucuggcacacuuggcaaaagcaaacccaaagauccggcguucuaugggacguacccagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcuauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaacuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagccgagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaaaggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacucaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacuccugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccacuacuagcacugggcugcuauucacaagugaacccacugacucucacagcggcaguacucuugcugauuacacauuaugcuauuauagguccaggauugcaggcaaaagccacucgugaagcucagaaaaggacagcugcuggaauaaugaaaaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggugguccaggacacgaagaaccaguaccuauguccacauauggauggaacauaguuaaauuaaugaguggaaaggauguguuuuaucuuccaccugaaaagugugacacccuguugugugacauuggagaaucuucaccaagcccaacaguggaagaaagcagaaccauaagaguuuugaagaugguugaaccauggcuaaagaacaaccaauuuugcauuaaaguauugaacccuuacaugccaacugugauugagcaccuagaaagacuacaaaggaaacauggagguaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaaccuagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggcggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucuaaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7360 - RNA, 9873 nt, Artificial Sequence
  derived and/or modified CDS sequence (wt) from DENV-3__FJ882576__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaagugguuauuuuuauacuacuaaugcuggucacuccauccauggcaaugagaugugugggaguaggaaacagagauuuuguggaaggucuaucgggagcuacguggguugacguggugcucgagcacggugggugugugacuaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaucuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacuuccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggacguacccagcccuccagagacacagaaagcagaacuggaagaaggggucuauaggaucaaacagcaaggaauuuuugggaaaacccaaguagggguuggaguacagaaagaaggagucuuccacaccauguggcacgucacaagaggggcaguguuggcauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagauccagccaguauagcggcuagaggguacauaucaacucguguaggaaugggagaggcagcugcaaucuucaugacagcaacgcccccuggaacagcugaugccuuuccucagagcaacgcuccaauucaagaugaagaaagggacaucccggaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggauuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggugaguccaggaagaccuucguggaacucaugaggaggggugaccucccaguuuggcuagcccauaaaguagcaucagaagggaucaaauauacagauagaaaauggugcuuugauggagaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaagauggacuuaggaguaccccuacuggcauugggcugcuauucacaagugaacccacugacucucacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacucucacgaaacuccacgcacgaaauguacuggauauccaaugguacaggcaacaucgucucuucagucaacaugguauccagauugcuacugaacagauuuacaaugacacacaggagacccaccauugagaaagauguggauuugggagcaggaacccgacaugucaaugcggaaccagaaacacccaauauggacgucauuggagaaagaauaaaaaggaucaaggaggagcauaauucaacauggcacuaugaugaugaaaauccuuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7361 - RNA, 9873 nt, Artificial Sequence
  derived and/or modified CDS sequence (wt) from DENV-3__FJ850052__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccgugcaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagauaaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7362 - RNA, 9873 nt, Artificial Sequence
  derived and/or modified CDS sequence (wt) from DENV-3__FJ873812__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauauccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcucgagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuuccucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacgugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaauccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuucgauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaagauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaagaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaacuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguucccuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7363 - RNA, 9873 nt, Artificial Sequence
  derived and/or modified CDS sequence (wt) from DENV-3__FJ873813__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccaaacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgcuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagauauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7364 - RNA, 9873 nt, Artificial Sequence
  derived and/or modified CDS sequence (wt) from DENV-3__FJ850048__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcaaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggagaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacagugauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguuaugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccggcugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugacuacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7365 - RNA, 9873 nt, Artificial Sequence
  derived and/or modified CDS sequence (wt) from DENV-3__FJ850049__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacuaacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcaaauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggauuacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7366 - RNA, 9873 nt, Artificial Sequence
  derived and/or modified CDS sequence (wt) from DENV-3__FJ898476__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguacugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7367 - RNA, 9873 nt, Artificial Sequence
  derived and/or modified CDS sequence (wt) from DENV-3__FJ898475__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcucgagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuuccucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacgugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaagauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaacuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguucccuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7368 - RNA, 9873 nt, Artificial Sequence
  derived and/or modified CDS sequence (wt) from DENV-3__GQ199861__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuugugcugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuaacgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggauuacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7369 - RNA, 9873 nt, Artificial Sequence
  derived and/or modified CDS sequence (wt) from DENV-3__GQ199862__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauucuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagcugcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaguaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7370 - RNA, 9873 nt, Artificial Sequence
  derived and/or modified CDS sequence (wt) from DENV-3__GQ199863__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagucaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugauauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcauuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaagcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcaaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaagggcugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7371 - RNA, 9873 nt, Artificial Sequence
  derived and/or modified CDS sequence (wt) from DENV-3__GQ199864__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuaaacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagagauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagaacaauacaaauuccaagcagacuccccaaaaagauuggcaacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccaaacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaauaggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgcuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7372 - RNA, 9873 nt, Artificial Sequence
  derived and/or modified CDS sequence (wt) from DENV-3__GQ199865__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcguguuacgucauaacuggcacgucagcagaccucaccguagaaaaagcagcagauauaacauggggggaagaggcugagcaaacaggagugucccacauguuaaugaucacaguugaggaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaaugcuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguugugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucauagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7373 - RNA, 9873 nt, Artificial Sequence
  derived and/or modified CDS sequence (wt) from DENV-3__GQ199870__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcgggaguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguccuggauauccaauggcacagguaacaucgucgcuucagucaauaugguaucuagacugcuacugaacagguccacgaugacacacagaagaccuaccauugagaaagauguggauuuaggagcaggaccucgacauguuaaugcggacccagaaccacccaauauggaugucauuggggaaagaauaaaaagggucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugccacagauggcaaugacagacacaacuccauuuggccagcagagagucuuuaaagagaaaguggacaccaggacacccagguccaucccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7374 - RNA, 9873 nt, Artificial Sequence
  derived and/or modified CDS sequence (wt) from DENV-3__JF937630__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucacuauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucaaccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguguugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7375 - RNA, 9873 nt, Artificial Sequence
  derived and/or modified CDS sequence (wt) from DENV-3__JN000936__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaaguugagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcagggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaggcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuugggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguugucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaacgacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauuggacucauuuguguaauuacuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacucuacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggaaaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaugacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7376 - RNA, 9873 nt, Artificial Sequence
  derived and/or modified CDS sequence (wt) from DENV-3__HQ541796__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacacagugauuggaauuggagacaacgccuugaaaaucaacugguauaagaagggaagcucuauugggaagauguucgaggccacugccagaggugcaaggcgcauggccaucuugggagauacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucguuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacauuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuacagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaccaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7377 - RNA, 9873 nt, Artificial Sequence
  derived and/or modified CDS sequence (wt) from DENV-3__HQ166034__SS-prME
acaucgcucugucucaugaugauauugccagcagcacuugcuuuccacuugaccucacgagauggagagccgcgcaugauuguggggaagaaugaaagaggaaaaucccuacuuuuuaagacggcuucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuagucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguccuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagcccggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuucaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaauguccaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggagcagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuggcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga
